United States Patent
Lindbo

(10) Patent No.: US 11,845,942 B2
(45) Date of Patent: Dec. 19, 2023

(54) COMPOSITIONS AND METHODS FOR GENOME EDITING

(71) Applicant: Vilmorin & Cie, Paris (FR)

(72) Inventor: John Lindbo, Woodland, CA (US)

(73) Assignee: Vilmorin & Cie, Paris (FR)

( * ) Notice: Subject to any disclaimer, the term of this patent is extended or adjusted under 35 U.S.C. 154(b) by 0 days.

(21) Appl. No.: 16/620,614

(22) PCT Filed: Jun. 7, 2018

(86) PCT No.: PCT/US2018/036480
§ 371 (c)(1),
(2) Date: Dec. 9, 2019

(87) PCT Pub. No.: WO2018/226972
PCT Pub. Date: Dec. 13, 2018

(65) Prior Publication Data
US 2020/0199605 A1    Jun. 25, 2020

Related U.S. Application Data

(60) Provisional application No. 62/517,360, filed on Jun. 9, 2017.

(51) Int. Cl.
C12N 15/82    (2006.01)
C12N 9/22    (2006.01)

(52) U.S. Cl.
CPC ........... *C12N 15/8213* (2013.01); *C12N 9/22* (2013.01); *C12N 2310/20* (2017.05)

(58) Field of Classification Search
CPC .................................................. C12N 15/1027
See application file for complete search history.

(56) References Cited

U.S. PATENT DOCUMENTS

| | | | |
|---|---|---|---|
| 5,316,931 A | 5/1994 | Donson et al. | |
| 5,959,185 A | 9/1999 | Streit et al. | |
| 5,973,234 A | 10/1999 | Mueller et al. | |
| 5,977,445 A | 11/1999 | Soper et al. | |
| 7,235,719 B2 * | 6/2007 | Zamir ................... | A01H 6/825 800/317.4 |
| 8,673,568 B2 | 3/2014 | Weill et al. | |
| 8,697,359 B1 | 4/2014 | Zhang | |
| 8,771,945 B1 | 7/2014 | Zhang | |
| 8,795,965 B2 | 8/2014 | Zhang | |
| 8,871,445 B2 | 10/2014 | Cong et al. | |
| 8,889,356 B2 | 11/2014 | Zhang | |
| 8,932,814 B2 | 1/2015 | Cong et al. | |
| 8,936,937 B2 | 1/2015 | Lindbo | |
| 8,945,839 B2 | 2/2015 | Zhang | |
| 9,102,936 B2 | 8/2015 | Zeiner et al. | |

FOREIGN PATENT DOCUMENTS

| | | | |
|---|---|---|---|
| WO | WO 2008/094512 A2 | 8/2008 | |
| WO | WO 2014/144155 A1 | 9/2014 | |
| WO | WO 2015/189693 A1 | 12/2015 | |
| WO | WO 2016/094872 A1 | 6/2016 | |
| WO | WO 2018/226972 A2 | 12/2018 | |

OTHER PUBLICATIONS

Makarova, K. et al. 2020 Nature Reviews Microbiology; 18: 67-83. (Year: 2020).*
Woo, J. et al., Nature Biotechnology (Nov. 2015) vol. 3, No. 11, pp. 1162-1165. (Year: 2015).*
De Vries, I.M. (1990) Plant Systematics and Evolution, vol. 171, pp. 233-248. (Year: 1990).*
Ariizumi, T. et al. (2011) Journal of Experimental Biology; vol. 62, No. 8, pp. 2773-2786. (Year: 2011).*
Woo Cho, S. et al., (Mar. 2013) Nature Biotechnology; vol. 31, No. 3; pp. 230-232. (Year: 2013).*
Ali et al., "Activity and specificity of TRV-mediated gene editing in plants," Plant Signaling and Behavior, Jun. 3, 2015, 11 pages.
Ali et al., "Efficient Virus-Mediated Genome Editing in Plants Using the CRISPR/Cas9 System," Molecular Plant, Aug. 2015;8(8):1288-91.
Bortesi et al., "The CRISPR/Cas9 system for plant genome editing and beyond," Biotech Advances, vol. 33(1), (2015), 12 pages.
Grdzelishvili et al., "Mapping of the Tobacco Mosaic Virus Movement Protein and Coat Protein Subgenomic RNA Promoters in Vivo," Virology 275, 177-192 (2000).
Haasnoot et al., "A conserved hairpin structure in Alfamovirus and Bromovirus subgenomic promoters is required for efficient RNA synthesis in vitro," RNA, 6, pp. 708-716 (2000).
Haasnoot et al. "The Brome mosaic virus subgenomic promoter hairpin is structurally similar to the iron-responsive element and functionally equivalent to the minus-strand core promoter stem-loop C," RNA, 8, pp. 110-122, 2002.
International Search Report and Written Opinion dated Aug. 27, 2018, for International Application No. PCT/US2018/036480, 10 pages.
Ishibashi K. et al., "Interactions between tobamovirus replication proteins and cellular factors: their impacts on virus multiplication," MPMI vol. 23, No. 11, 2010, pp. 1413-1419.
Ishibashi K et al., "Replication of tobamovirus RNA," Annu Rev Phytopathol. Aug. 4, 2016; 54: 55-78.
Jones, H. D., "Regulatory uncertainty over genome editing," Natural Plants, vol. 1, Article No. 14011, Jan. 8, 2015, 3 pages.

(Continued)

Primary Examiner — Russell Kallis
(74) Attorney, Agent, or Firm — Cooley LLP

(57) ABSTRACT

The present disclosure provides compositions, methods, and systems for targeted plant genome editing. In some embodiments, the present disclosure provides recombinant self-replicating RNAs derived from a plant virus vector, such as those derived from Tobacco Mosaic Virus (TMV). In some embodiments, the recombinant self-replicating RNAs direct the expression of both a CRISPR endonuclease and a guide RNA capable of directing sequence-specific binding of the CRISPR endonuclease to a target DNA in the genome of plant cell.

19 Claims, 20 Drawing Sheets
Specification includes a Sequence Listing.

(56) References Cited

OTHER PUBLICATIONS

Koev et al., "A positive-strand RNA virus with three very different subgenomic RNA promoters," J. Virol., 74, pp. 5988-5996 (2000).
Lindbo, "TRBO: a high-efficiency tobacco mosaic virus RNA-based overexpression vector," Plant Physiol. Dec. 2007;145(4):1232-40.
Nekrasov et al. "Targeted mutagenesis in the model plant Nicotiana benthamiana using Cas9 RNA-guided endonuclease," Nature Biotechnology 8(31): 691-693 (2013).
Olea et al., "Real-Time Detection of a Self-Replicating RNA Enzyme," Molecules. Sep. 30, 2016;21(10).
Pogue et al., "Tobamovirus Transient Expression Vectors: Tools for Plant Biology and High-Level Expression of Foreign Proteins in Plants," Plant Molecular Biology Manual, L4: 1-27. Kluwer Academic Publishers (1998).
Cho et al., "Targeted genome engineering in human cells with the Cas9 RNA-guided endonuclease," Nature Biotechnology, vol. 31, No. 3, Mar. 1, 2013, 14 pages.
Cong et al., "Multiplex Genome Engineering Using CRISPR/Cas Systems," Science, vol. 339, No. 6121, Feb. 14, 2013, pp. 819-823.
Extended European Search Report dated Mar. 12, 2021, for European Application No. 18813973.7, 8 pages.
Mali et al., "RNA-Guided Human Genome Engineering via Cas9," Science, Feb. 15, 2013, vol. 339(6121), pp. 823-826.

\* cited by examiner

| Description of delivery Method | Host range | Transgenic |
|---|---|---|
| Protein-RNA complex delivered to protoplasts | Narrow: Must be able to regenerate plants from protoplasts | No |
| Expression plasmids delivered to protoplasts. | Narrow: Must be able to regenerate plants from protoplasts | Sometimes |
| Agrobacterium delivery of Transgenes to explants or embryos. | Broad: Any species for which Agrobacterium transformation exists. | Yes |
| Cas9 Transgenic + sgRNA expressed from RNA virus: Possible delivery to explants or embryos | Potentially broad: Any species capable of replicating the recombinant RNA | No |

Figure 2

Figure 10
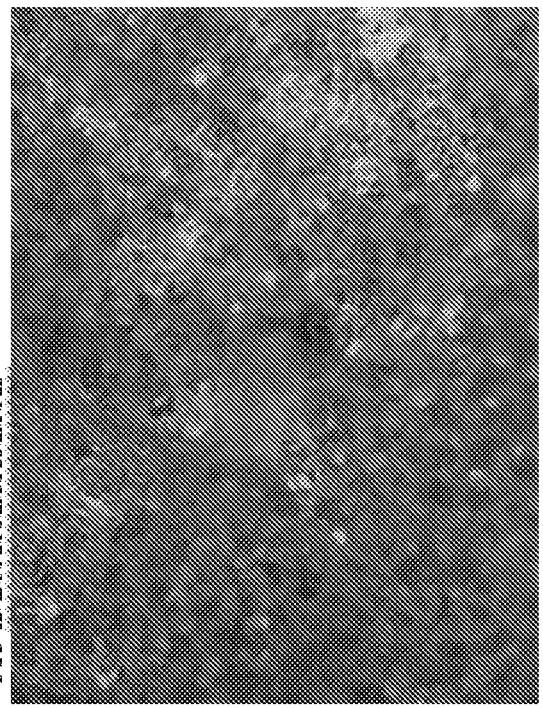
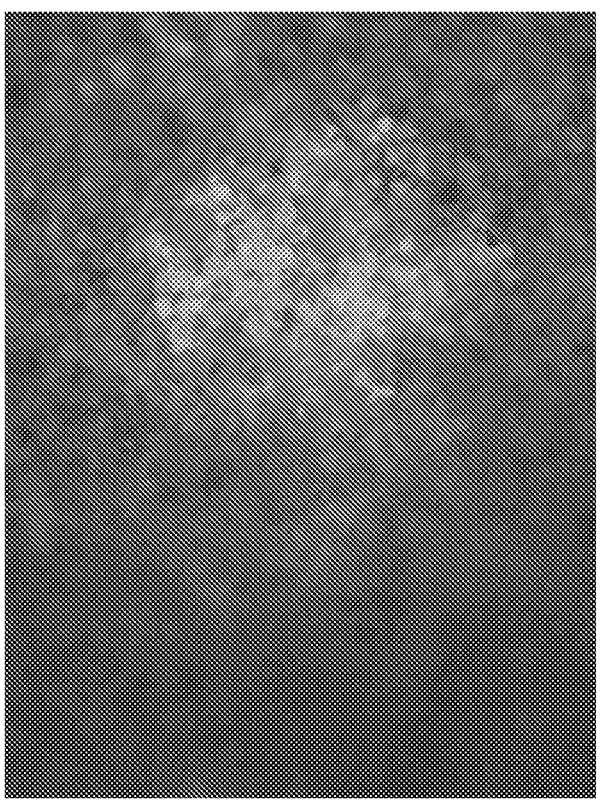

Figure 12

```
186_Cas9 Pr        TCAGTGCCGAACAAGAACTATAGAAATGTTAAGGATTTTGGAGGAATGAGTTTTAAAAAG   60  (SEQ ID No. 65)
187_Cas9Prom       -CAGTGCCGAACAAGAACTATAGAAATGTTAAGGATTTTGGAGGAATGAGTTTTAAAAAG   59  (SEQ ID No. 66)
187_gRNAProm       ------------------------CCTAGAACTAAGATGGAGGAATGGAGTTTTAAAAAG   35  (SEQ ID No. 67)
186_gRNA_Prom_synth ----------------------CCATCGTATTTCTAGCAATGAACTGGAAAATTA      50  (SEQ ID No. 68)
                                                    *  *      *** sgPCAs9186         AATAATTAATCGATGATGATTCGGAGGCTACTGTCGCCGAATCGTTTTAAATA        120
187CAsProm         AATAATTAATCGATGATGATGATTCGGAGGCTACTGTCGCCGAATCGGATCGTTTTAAATA 119
187GRNAProm        AATTAACGGCTCGATGATGATGATTCGGAGGCTACTGTCGCCGAATCGGATCGGATTTTAAATA 95
synProm186GRNA     AATTAACGGCTCGATGATGATTCGGAGGCTACTGTCGCCGAATCGGATTCGTTGCCGTTTA 110
                   *                 ********************* sgPCAs9186         GATCTTACAGTATCACTACTCCATCTCAGTTCGTGTTCTTGTCA 18
187CAsProm         GATCTTACAGTATCACTACTCCATCTCAGTTCGTGTTCGTTCTTGTCA 18
187GRNAProm        GATCTTACAGTATCACTACTCCATCTCAGTTCGTGTTCGTTCTTGTCA 15
synProm186GRNA     ATTTGAGAGTCCAGTTTTAGAGCTAGAAATAGCAAG----------- 15
                    *                      *   *
```

16

A

B

COMPOSITIONS AND METHODS FOR GENOME EDITING

CROSS-REFERENCE TO RELATED APPLICATION

The present application claims priority to, and the benefit of U.S. Provisional Patent Application Ser. No. 62/517,360, filed on Jun. 9, 2017, which is herein incorporated by reference in its entirety.

DESCRIPTION OF TEXT FILE SUBMITTED ELECTRONICALLY

The contents of the text file submitted electronically herewith are incorporated herein by reference in their entirety: A computer readable format copy of the Sequence Listing (filename: VILM_024_01WO_SeqList_ST25.txt, date recorded: Jun. 4, 2018, file size: ~1024 kilobytes).

FIELD OF THE INVENTION

The present disclosure generally relates to systems, methods, compositions used for guided genetic sequence editing in plants, and plants obtained by such methods. The disclosure describes, inter alia, methods of using novel recombinant RNA sequences (e.g., RNA sequences derived from virus, such as Tobacco Mosaic TobamoVirus, TMV) for improved sequence-specific DNA cutting in plants. Sequence specific DNA cleavage (or nicking) in plants has applications in both research as well as for the improvement of commercial crops and research plants.

BACKGROUND

A major area of interest in biology is the targeted editing of genetic sequences. Clustered regularly interspaced short palindromic repeats (CRISPR) systems are a new class of genome-editing tools capable of targeting and modifying selected target DNA loci.

CRISPR editing begins with a double stranded DNA break catalyzed by the CRISPR complex that triggers a cell's homology-directed repair (HDR) or non-homologous end joining repair (NHEJ) mechanisms. Modern gene editing techniques exploit the HDR and NHEJ processes to knock in replacement DNA sections or mutate selected genes in an organism.

A key challenge in this field however, is how to deliver the CRISPR complex to living cells. Most methods to date have relied on the use of recombinant DNA molecules to transiently express CRISPR complexes in living organisms. The downside of this approach is that the recombinant DNAs are often (~20% of the time) inadvertently integrated into the genome of the target organism. This results in an unintended transgenic event that produces undesirable side effects, and triggers additional regulatory controls on the engineered product.

Thus, there is a need for improved methods and compositions for the delivery of gene editing complexes to living organisms.

SUMMARY OF THE DISCLOSURE

In some embodiments, the present disclosure teaches expression of a functional CRISPR complex derived from an RNA virus vector. In some embodiments, the RNA virus vector is based on a single strand RNA virus. In some embodiments, the single strand RNA virus is a plant virus. In some embodiments, the single strand RNA virus is a Tobamovirus, such as the tobacco mosaic virus (TMV).

In some embodiments, the present disclosure teaches a recombinant self-replicating RNA, wherein said recombinant self-replicating RNA encodes at least one or more genes selected from the group consisting of i) a replicase capable of transcribing the recombinant self-replicating RNA, ii) a movement protein facilitating intercellular movement of the RNA, iii) a Clustered regularly interspaced short palindromic repeats (CRISPR) endonuclease, and iv) at least one guide RNA: wherein said at least one guide RNA is capable of directing sequence-specific binding of the CRISPR endonuclease to target DNA.

In some embodiments, the present disclosure teaches a recombinant self-replicating RNA, wherein said recombinant self-replicating RNA encodes at least i) a replicase capable of transcribing the recombinant self-replicating RNA, iii) a Clustered regularly interspaced short palindromic repeats (CRISPR) endonuclease, and iv) at least one guide RNA; wherein said at least one guide RNA is capable of directing sequence-specific binding of the CRISPR endonuclease to target DNA.

In some embodiments, the recombinant self-replicating RNAs of the present disclosure are compatible with a targetable nuclease, including, but not limited to TALENS, ZFNS, or other meganucleases.

Thus, in some embodiments, the present disclosure teaches a recombinant self-replicating RNA, wherein said recombinant self-replicating RNA encodes at least i) a replicase capable of transcribing the recombinant self-replicating RNA, and ii) a targetable nuclease capable of directing sequence-specific cutting of a target DNA.

In some embodiments, the present disclosure teaches a recombinant self-replicating RNA, wherein the recombinant self-replicating RNA is capable of intercellular movement in a plant host.

In some embodiments, the present disclosure teaches a recombinant self-replicating RNA, wherein the CRISPR endonuclease to which the guide RNA sequence in the recombinant self-replicating RNA capable of binding is Cas9. In some embodiments, the Cas9 endonuclease is engineered to alter nuclease cleavage sequence.

In some embodiments, the present disclosure teaches a recombinant self-replicating RNA, wherein the RNA does not comprise a sequence encoding a coat protein.

In some embodiments, the present disclosure teaches a recombinant self-replicating RNA, wherein the at least one guide RNA is expressed by a first subgenomic promoter and the CRISPR endonuclease is expressed by a second subgenomic promoter. In some embodiments, the first subgenomic promoter and the second subgenomic promoter are the same, or different.

In some embodiments, the present disclosure teaches a recombinant self-replicating RNA, wherein the first and/or second subgenomic promoter is a synthetic subgenomic promoter. In some embodiments, the synthetic subgenomic promoter comprises the sequence according to SEQ ID No. 68, or functional variants thereof, such as sequence having at least 80% homology to SEQ ID No. 68.

In some embodiments, the present disclosure teaches a recombinant self-replicating RNA, wherein the at least one guide RNA when expressed from the recombinant self-replicating RNA comprises at least two extra nucleotides at its 5' and/or 3' end than would be expected if the same guide RNA were to be expressed by a RNA Polymerase III in an eukaryotic in vivo expression system.

In some embodiments, the extra nucleotides at the 5' and/or 3' end of the at least one guide RNA is different from would be expected if the same guide RNA were to be expressed using a vector derived from the genome of Tobacco Rattle Virus (TRV).

In some embodiments, the present disclosure teaches a recombinant self-replicating RNA, wherein the self-replicating RNA is derived from the genome of Tobacco Mosaic Virus (TMV).

In some embodiments, the present disclosure teaches a recombinant self-replicating RNA, wherein the replicase encoded by the recombinant self-replicating RNA shares at least 80% sequence identity to SEQ ID No. 71.

In some embodiments, the present disclosure teaches a recombinant self-replicating RNA, wherein the movement protein encoded by the recombinant self-replicating RNA shares at least 80% sequence identity to SEQ ID No. 74.

In some embodiments, the present disclosure teaches a recombinant self-replicating RNA, wherein the CRISPR endonuclease encoded by the recombinant self-replicating RNA comprises an amino acid sequence according to SEQ ID. No. 3.

In some embodiments, the present disclosure teaches a recombinant self-replicating RNA, wherein the guide RNA in the recombinant self-replicating RNA comprises an nucleic acid sequence according to SEQ ID. No. 81, or functional variants thereof, such as sequence having at least 80% homology to SEQ ID No. 81.

In some embodiments, the present disclosure teaches a DNA vector comprising a polynucleotide encoding the recombinant self-replicating RNA of the present disclosure.

In some embodiments, the present disclosure teaches a DNA vector, wherein the polynucleotide in the DNA vector is operably linked to a promoter.

In some embodiments, the present disclosure teaches a DNA vector, wherein the promoter in the DNA vector is a promoter capable of expressing in a plant host organism.

In some embodiments, the present disclosure teaches a DNA vector, wherein the promoter in the DNA vector is a T7 promoter.

In some embodiments, the present disclosure teaches a DNA vector, wherein the DNA vector is derived from the genome of Tobacco Mosaic Virus (TMV).

In some embodiments, the polynucleotide encoding the recombinant self-replicating RNA is operably linked to a 3' UTR region. In some embodiments, the 3' UTR region comprises a terminator sequence. In some embodiments, the terminator sequence comprises CaMV (Cauliflower mosaic virus) 35S terminator. In some embodiments, the 3' UTR region comprises the 3' end sequence derived from pJL TRBO vector (Lindbo, *Plant Physiol.* 2007 December: 145(4): 1232-40).

In some embodiments, the present disclosure teaches a method for editing the genome of a plant, said method comprising the steps of a) introducing into a cell of the plant at least one recombinant self-replicating RNA according to the invention. In some embodiments, said recombinant self-replicating RNA encodes at least one or more genes selected from the group consisting of: i) a replicase capable of transcribing the recombinant self-replicating RNA: ii) a movement protein facilitating intercellular movement of the RNA, iii) a CRISPR endonuclease: and iv) at least one guide RNA that comprises a guide sequence, wherein said at least one guide sequence hybridizes to a selected target sequence (or sequences) within the genome of the plant. In some embodiments, when elements (i), (ii), (iii) and (iv) are expressed in the cell, the CRISPR endonuclease cleaves the cell's genome at the selected target sequence, thereby editing the plant genome.

In some embodiments, the present disclosure teaches a genetically edited plant cell, plant part, plant, and plant progeny produced by the gene editing methods of the present invention.

In some embodiments, the present disclosure teaches a method for editing the genome of a plant, wherein the method comprise introducing into a cell of the plant at least one DNA vector comprising a polynucleotide encoding the recombinant self-replicating RNA of the present disclosure.

In some embodiments, the recombinant self-replicating RNA used for genome editing method of the present disclosure is not integrated into the genome of the cell.

In some embodiments, the recombinant self-replicating RNA used for genome editing method of the present disclosure is capable of intercellular movement in the plant.

In some embodiments, the CRISPR endonuclease encoded by a recombinant self-replicating RNA used for genome editing method of the present disclosure is Cas9.

In some embodiments, the introducing step a) of the method for editing the genome of a plant described above comprises i) agro infiltrating a DNA vector comprising a polynucleotide encoding the recombinant self-replicating RNA according to the invention into the plant cell; ii) contacting the recombinant self-replicating RNA according to the invention or a DNA vector comprising a polynucleotide encoding the recombinant self-replicating RNA with the plant cell; iii) electroporating the recombinant self-replicating RNA according to the invention, or a DNA vector comprising a polynucleotide encoding said recombinant self-replicating RNA into the plant cell, iv) mechanical inoculation and/or v) biolistically delivering the recombinant self-replicating RNA according to the invention, or a DNA vector comprising a polynucleotide encoding said recombinant self-replicating RNA into the plant cell.

In some embodiments, the present disclosure teaches a genetically edited plant cell, plant part, plant, or plant progeny produced by the methods of the gene editing methods of the present invention.

In some embodiments, the method for editing genome of a plant according to the present disclosure further comprises the step of b) screening the cell of the plant for the presence of a mutation in the selected target sequence of the plant cell genome.

In some embodiments, the method for editing genome of a plant according to the present disclosure further comprises the step of c) regenerating the plant cell comprising the mutation identified in step (b) to produce a genetically edited plant.

In some embodiments, the present disclosure teaches a genetically edited plant generated from the edited plant cell or plant part as described above.

In some embodiments, the present disclosure teaches a composition comprising the DNA vector comprising a polynucleotide encoding for the recombinant self-replicating RNA of the present invention, and a composition comprising the recombinant self-replicating RNA of the present invention.

In some embodiments, the present disclosure teaches a cell comprising the recombinant self-replicating RNA of the present invention.

In some embodiments, the present disclosure teaches a cell comprising the DNA vector of the present invention.

In some embodiments, the present disclosure teaches a genetically edited plant cell, plant part, plant, or plant progeny comprising at least one genetic mutation produced by the gene editing methods of the present invention.

In some embodiments, the present disclosure teaches a method for producing a plant seed, wherein the method comprises crossing a genetically edited plant produced by the gene editing methods of the present invention with a second plant of the same species, and harvesting the resultant seed, wherein the seed comprises the genetic mutation of the genetically edited plant. In some embodiments, the second plant is different from the genetically edited plant produced by the gene editing methods of the present invention.

In some embodiments, the present disclosure teaches a method for producing a plant seed, wherein the method comprises crossing a first genetically edited plant produced by the gene editing methods of the present invention with a second genetically edited plant of the same species produced by the gene editing methods of the present invention, and harvesting the resultant seed, wherein the seed comprises the genetic mutations of the first and the second genetically edited plants. In some embodiments, the second genetically edited plant is different from the first genetically edited plant, i.e. second genetically edited plant does not harbor the same mutation that the mutation of the first genetically edited plant.

In some embodiments, the present disclosure teaches a plant seed obtained from the breeding method of the present invention.

In some embodiments, the present disclosure teaches a method for producing a plant progeny, wherein the method comprises crossing the genetically edited plant produced by the gene editing methods of the present invention with a second plant of the same species. In some embodiments, the second plant is different from the genetically edited plant produced by the gene editing methods of the present invention. In some embodiments, the second plant comprises a gene that confers the progeny plant with a phenotype selected from the group consisting of male sterility, male fertility, herbicide resistance, insect resistance, disease resistance, water stress tolerance, and increased digestibility. In some embodiments, the second plant is also a genetically edited plant produced by the gene editing methods of the present invention, but comprising a different mutation than said first genetically edited plant.

In some embodiments, the present disclosure teaches a plant progeny produced by the breeding methods of the present invention.

In some embodiments, the present disclosure teaches a method for producing nucleic acids, comprising isolating nucleic acids from the plant cell, plant part, plant, or plant progeny according to the invention.

In some embodiments, the present disclosure teaches a method for producing a second plant, the method comprising applying plant breeding techniques to the plant or plant part produced by the gene editing methods of the present invention.

BRIEF DESCRIPTION OF THE FIGURES

FIG. 1A—Delivery of protein-RNA complexes to protoplasts requires protoplast cell wall regeneration followed by tissue culture to regenerate full plants. FIG. 1B—Delivery of CRISPR and guide RNA plasmids to protoplasts via electroporation, PEG, or other transformation methods requires protoplast cell wall regeneration followed by tissue culture to regenerate full plants. FIG. 1C—Agrobacterium-based delivery of DNA plasmids requires regeneration of explant or callus tissue into full plants. This process is limited by Agrobacterium host range and ability to regenerate plants. FIG. 1D—recombinant self-replicating RNAs of the present disclosure can be delivered to explant, which can then be regenerated into full plants. FIG. 1E—recombinant self-replicating RNAs of the present disclosure can also be directly delivered to growing plants to create gene edits in germ-line cells, which are inherited by progeny plants.

FIG. 2—Comparison of different strategies for delivering CRISPR complexes for editing plants. CRISPR complex delivery via RNA as presently disclosed does not produce transgenics and is not limited by agrobacterium host ranges.

FIG. 3A—Map of the expression cassette of plasmids pJL 125 and pJL 122. 35S=CAMV 35S Promoter; Cas9=Cas9 ORF; term=transcriptional terminator. U6=A. thaliana U6 promoter; PDS@Mlyl=sgRNA specific for an Mlyl site in N. benthamiana PDS gene sequence. FIG. 3B—Examples of Cas9 triggered indel mutations recovered from transient expression of pJL 122 and pJL 125 T-DNAs in N. benthamiana cells.

FIG. 4A—Map of T-DNA regions of plasmids used to establish whether or not self-replicating RNAs could express CRISPR endonucleases. The Replicase, MP, and CP boxes represent Tobacco Mosaic Virus (TMV) open reading frames (ORF). Replicase=TMV RNA dependent RNA polymerase; MP=movement protein ORF; CP=Coat Protein ORF. Other abbreviations same as earlier figures. FIG. 4B—Sequences of indel mutations recovered from expression of Cas9 from TMV vector and sgRNA from pJL 122 in N. benthamiana cells.

FIG. 5A—Map of T-DNA regions of plasmids used to establish functionality of RNA-expressed guide RNAs. FIG. 5B—Examples of Cas9 triggered indel mutations recovered from transient expression of Cas9 from pJL 125 T-DNA, and sgRNA from the TMV vector in pJL 155 in N. benthamiana cells.

FIG. 6A—Cassette maps of vectors expressing recombinant self-replicating RNAs, according to the present disclosure. The recombinant self-replicating RNAs encode for both a Cas9 protein and a guide RNA targeting the MlyI site in the phytoene desaturase (PDS) gene. Vectors were delivered to N. benthamiana leaf cells by agroinfection. FIG. 6B—examples of indel mutations recovered from leaf cells infiltrated (exposed to) Agrobacterium cultures carrying pJL 159. FIG. 6C—examples of indel mutations recovered from leaf cells infiltrated (exposed to) Agrobacterium cultures carrying pJL 165.

FIG. 10—Depicts Cas9-2a-GFP fusions expressed from T-DNA (pJL 124) or viral vector (pJL 126). Several days post infiltration of Agro with these plasmids, infiltrated leaf tissue was examined under UV light, to trigger GFP.

FIG. 12—Depicts an alignment of subgenomic promoters, according to selected embodiments of the present disclosure. "Full strength" wild type subgenomic promoter extends to approximately 54 nts downstream of transcription start, and approximately 100 nts upstream of the transcriptional start site. This sequence is denoted by the S symbol above the sequences on the alignment above. The 54 nts downstream of the transcription start site are all TMV derived sequences. The start site of transcription is denoted by the #. The sequences shown above are all of the virus "sense" or genome strand. The actual subgenomic promoter is the reverse compliment of this. Sense strand is simply shown for clarity. Synthetic promoter engineered to fold into a structure similar to that of the U wild type subgenomic promoter is in italics, and spans approximately 122 nts (SEQ ID No. 68). Extensive sequence changes downstream of the transcription start site, and complementary sequence changes greater than 41 nts upstream of the transcription start site, were designed to maintain the secondary structure needed for the subgenomic promoter function (see FIG. 11 for structure; see also Grdzelishvili et al., "Mapping of the Tobacco Mosaic Virus Movement Protein and Coat Protein Subgenomic RNA Promoters in Vivo" Virology 275. 177-192 (2000), for a discussion on subgenomic promoter design and folding). The sequence of the spacer region of the gRNA is underlined.

FIG. 20A shows indel spectrum on a single pool of from $E.$ $coli$, colonies (3 minipreps in each pool) having significant indel mutations detected in TIDE analysis. FIG. 20B shows indel spectrum on 7 pools of from $E.$ $coli$, colonies (3 minipreps in each pool) having no significant indel mutations.

DETAILED DESCRIPTION

Definitions

Figures 1A, 1B, 1C, 1D, 1E:
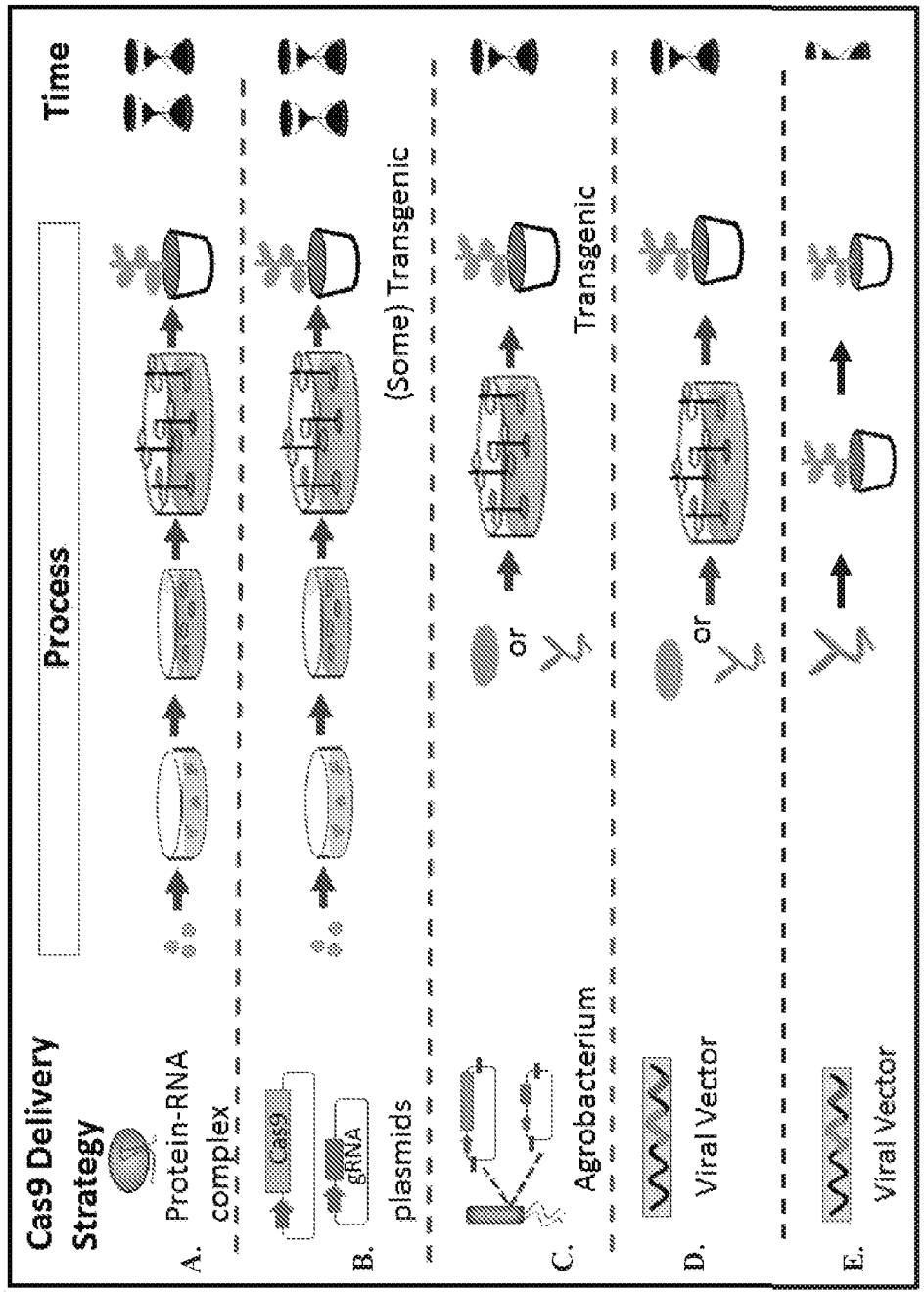
FIG. 1A to FIG. 1E—Overview of different CRISPR delivery strategies, processes and relative time requirements.

While the following terms are believed to be well understood by one of ordinary skill in the art, the following definitions are set forth to facilitate explanation of the presently disclosed subject matter.

The term "a" or "an" refers to one or more of that entity, i.e., can refer to a plural referents. As such, the terms "a" or "an", "one or more" and "at least one" are used interchangeably herein. In addition, reference to "an element" by the indefinite article "a" or "an" does not exclude the possibility that more than one of the elements is present, unless the context clearly requires that there is one and only one of the elements.

The term "genetically engineered" may refer to any manipulation of a host cell's genome (e.g. by insertion or deletion of nucleic acids). The term "genetically edited" refers to a host cell whose genome has been edited by a CRISPR complex.

As used herein, the term "nucleic acid" refers to a polymeric form of nucleotides of any length, either ribonucleotides or deoxyribonucleotides, or analogs thereof. This term refers to the primary structure of the molecule, and thus includes double- and single-stranded DNA, as well as double- and single-stranded RNA. It also includes modified nucleic acids such as methylated and/or capped nucleic acids, nucleic acids containing modified bases, backbone modifications, and the like. The terms "nucleic acid" and "nucleotide sequence" are used interchangeably.

As used herein, the term "gene" refers to any segment of DNA associated with a biological function. Thus, genes include, but are not limited to, promoter sequences, terminator sequences, splice sites, polyubiquitination sites, intron sequences, coding sequences and/or the regulatory sequences required for their expression. Genes can also include non-expressed DNA segments that, for example, form recognition sequences for other proteins, such as a guide RNA. Genes can be obtained from a variety of sources, including cloning from a source of interest or synthesizing from known or predicted sequence information, and may include sequences designed to have desired parameters.

As used herein, the term "homologous" or "homologue" or "ortholog" is known in the art and refers to related sequences that share a common ancestor or family member and are determined based on the degree of sequence identity. The terms "homology," "homologous," "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant disclosure such as deletion or insertion of one or more nucleotides that do not substantially alter the functional properties of the resulting nucleic acid fragment relative to the initial, unmodified fragment. It is therefore understood, as those skilled in the art will appreciate, that the disclosure encompasses more than the specific exemplary sequences. These terms describe the relationship between a gene found in one species, subspecies, variety, cultivar or strain and the corresponding or equivalent gene in another species, subspecies, variety, cultivar or strain. For purposes of this disclosure, homologous sequences are compared. "Homologous sequences", "homologues", or "orthologs" are thought, believed, or known to be functionally related. A functional relationship may be indicated in any one of a number of ways, including, but not limited to: (a) degree of sequence identity and/or (b) the same or similar biological function. In some embodiments, both (a) and (b) are indicated. Homology can be determined using software programs readily available in the art, such as those discussed in Current Protocols in Molecular Biology (F. M. Ausubel et al., eds., 1987) Supplement 30, section 7.718, Table 7.71. Some alignment programs are MacVector (Oxford Molecular Ltd, Oxford, U.K.), ALIGN Plus (Scientific and Educational Software, Pennsylvania) and AlignX (Vector NTI, Invitrogen, Carlsbad, CA). Another alignment program is Sequencher (Gene Codes, Ann Arbor, Michigan), using default parameters.

As used herein, the term "nucleotide change" refers to, e.g., nucleotide substitution, deletion, and/or insertion, as is well understood in the art. For example, mutations contain alterations that produce silent substitutions, additions, or deletions, but do not alter the properties or activities of the encoded protein or how the proteins are made.

As used herein, the term "protein modification" refers to, e.g., amino acid substitution, amino acid modification, deletion, and/or insertion, as is well understood in the art.

As used herein, the term "at least a portion" or "fragment" of a nucleic acid or polypeptide means a portion having the minimal size characteristics of such sequences, or any larger fragment of the full length molecule, up to and including the full length molecule. A fragment of a polynucleotide of the disclosure may encode a biologically active portion of a genetic regulatory element. A biologically active portion of a genetic regulatory element can be prepared by isolating a portion of one of the polynucleotides of the disclosure that comprises the genetic regulatory element and assessing activity as described herein. Similarly, a portion of a polypeptide may be 4 amino acids, 5 amino acids, 6 amino acids, 7 amino acids, and so on, going up to the full length polypeptide. The length of the portion to be used will depend on the particular application. A portion of a nucleic acid useful as a hybridization probe may be as short as 12 nucleotides; in some embodiments, it is 20 nucleotides. A portion of a polypeptide useful as an epitope may be as short as 4 amino acids. A portion of a polypeptide that performs the function of the full-length polypeptide would generally be longer than 4 amino acids.

For PCR amplifications of the polynucleotides disclosed herein, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook et al. (2001) Molecular Cloning: A Laboratory Manual (3rd ed., Cold Spring Harbor Laboratory Press, Plainview, New York). See also Innis et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York). Known methods of PCR include, but are not limited to, methods using paired primers, nested primers, single specific primers, degenerate primers, gene-specific primers, vector-specific primers, partially mismatched primers, and the like.

The term "primer" as used herein refers to an oligonucleotide which is capable of annealing to the amplification target allowing a DNA polymerase to attach, thereby serving as a point of initiation of DNA synthesis when placed under conditions in which synthesis of primer extension product is induced, i.e., in the presence of nucleotides and an agent for polymerization such as DNA polymerase and at a suitable temperature and pH. In some embodiments, the (amplification) primer is single stranded for maximum efficiency in amplification. In some embodiments, the primer is an oligodeoxyribonucleotide. The primer must be sufficiently long to prime the synthesis of extension products in the presence of the agent for polymerization. The exact lengths of the primers will depend on many factors, including temperature and composition (A/T vs. G/C content) of primer. A pair of bi-directional primers consists of one forward and one reverse primer as commonly used in the art of DNA amplification such as in PCR amplification.

The term "hybridization" as used herein refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence.

As used herein. "promoter" refers to a DNA sequence capable of controlling the expression of a coding sequence or functional RNA. The promoter sequence may consist of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue specificity of a promoter.

As used herein, the term "Pol II promoter" refers to a promoter that is capable of being recognized and transcribed by the Pol II polymerase (a.k.a. RNA polymerase II). The term "Pol III promoter" refers to a promoter that is capable of being recognized and transcribed by the Pol III polymerase (a.k.a. RNA polymerase III).

As used herein, the term "subgenomic promoter" in an RNA virus (such as TMV) refers to those RNA sequences capable of being recognized by viral-encoded RNA dependent RNA polymerase to direct the production of 'subgenome length' RNAs. Production of subgenomic RNAs from viral genomes is a common gene expression and RNA synthesis strategy for many virus groups. (For more information on different gene expression strategies of plant viruses in particular see Mathew's Plant Virology (2004) Roger Hull. Elsevier Academic Press, especially pp 225-292).

The term "operably linked" means in this context the sequential arrangement of the promoter polynucleotide according to the disclosure with a further oligo- or polynucleotide, resulting in transcription of said further polynucleotide. In some embodiments, the promoter sequences of the present disclosure are inserted just prior to a gene's 5'UTR, or open reading frame. In other embodiments, the operably linked promoter sequences and gene sequences of the present disclosure are separated by one or more linker nucleotides.

As used herein, the phrases "recombinant construct", "expression construct", "chimeric construct", "construct", "recombinant DNA construct" and "recombinant RNA" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such construct may be used by itself or may be used in conjunction with a vector. If a vector is used then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the disclosure. The skilled artisan will also recognize that different independent transformation events will result in different levels and patterns of expression (Jones et al., (1985) EMBO J. 4:2411-2418; De Almeida et al., (1989) Mol. Gen. Genetics 218:78-86), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others. Vectors can be plasmids, viruses, bacteriophages, pro-viruses, phagemids, transposons, artificial chromosomes, and the like, that replicate autonomously or can integrate into a chromosome of a host cell. A vector can also be a naked RNA polynucleotide, a naked DNA polynucleotide, polynucleotide composed of both DNA and RNA within the same strand, a poly-lysine-conjugated DNA or RNA, a peptide-conjugated DNA or RNA, a liposome-conjugated DNA, or the like, that is not autonomously replicating. As used herein, the term "expression" refers to the production of a functional end product e.g., an mRNA or a protein (precursor or mature).

The term "CRISPR RNA" or "crRNA" refers to the guide RNA strand responsible for hybridizing with target DNA sequences, and recruiting CRISPR endonucleases. crRNAs may be naturally occurring, or may be synthesized according to any known method of producing RNA. The term crRNA and guide strand (gRNA) are equivalent, and may be interchangeably used throughout this document.

The term "tracrRNA" refers to a small trans-encoded RNA. TracrRNA is complementary to and base pairs with crRNA to form a crRNA/tracrRNA hybrid, capable of recruiting CRISPR endonucleases to target sequences.

The term "guide sequence" or "spacer sequence" refers to the portion of a crRNA that is responsible for hybridizing with the target DNA.

The term "protospacer" refers to the DNA sequence targeted by a crRNA or sgRNA guide strand. In some embodiments the protospacer sequence hybridizes with the crRNA or sgRNA guide (spacer) sequence of a CRISPR complex.

The term "seed region" refers to the critical portion of a crRNA's or guide RNA's guide sequence that is most susceptible to mismatches with their targets. In some embodiments, a single mismatch in the seed region of a crRNA can render a CRISPR complex inactive at that binding site. In some embodiments, the seed regions for Cas9 endonucleases are located along that last 12 nts of the 3' portion of the guide sequence. In some embodiments, the seed regions for Cpf1 endonucleases are located along the first 5 nts of the 5' portion of the guide strand.

The term "Guide RNA" or "gRNA" as used herein refers to an RNA sequence or combination of sequences capable of recruiting a CRISPR endonuclease to a target sequence. Thus as used herein, a guide RNA can be a natural or synthetic crRNA (e.g., for Cpf1), a natural or synthetic crRNA/tracrRNA hybrid (e.g., for Cas9), or a single-guide RNA (sgRNA).

The term "CRISPR landing site" as used herein, refers to a DNA sequence capable of being targeted by a CRISPR complex. Thus, in some embodiments, a CRISPR landing site comprises a proximately placed protospacer/Protopacer Adjacent Motif (PAM) combination sequence that is capable of being cleaved a CRISPR endonuclease complex.

The term "validated CRISPR landing site" refers to a CRISPR landing site for which there exists a guide RNA capable of inducing cleavage of said sequence. Thus, the term validated should be interpreted as meaning that the sequence has been previously shown to be cleavable by a CRISPR complex. Each "validated CRISPR landing site" will by definition confirm the existence of a tested guide RNA associated with the validation.

As used herein, the term "CRISPR complex" refers to a CRISPR endonuclease and guide RNA complex. The term CRISPR complex thus refers to a combination of CRISPR endonuclease and guide RNA capable of inducing a double stranded break at a CRISPR landing site.

As used herein, the term "directing sequence-specific binding" in the context of CRISPR complexes refers to a guide RNA's ability to recruit a CRISPR endonuclease to a CRISPR landing site.

As used herein the term "targeted" refers to the expectation that one item or molecule will interact with another item or molecule with a degree of specificity, so as to exclude non-targeted items or molecules. For example, a first polynucleotide that is targeted to a second polynucleotide, according to the present disclosure has been designed to hybridize with the second polynucleotide in a sequence specific manner (e.g., via Watson-crick base pairing). In some embodiments, the selected region of hybridization is designed so as to render the hybridization unique to the one, or more targeted regions. A second polynucleotide can cease to be a target of a first targeting polynucleotide, if its targeting sequence (region of hybridization) is mutated, or is otherwise removed/separated from the second polynucleotide.

The term "plant" refers to whole plants. The term "plant part" include differentiated and undifferentiated tissues including but not limited to plant organs, plant tissues, roots, stems, shoots, rootstocks, scions, stipules, petals, leaves, flowers, ovules, pollens, bracts, petioles, internodes, bark, pubescence, tillers, rhizomes, fronds, blades, stamens, fruits, seeds, tumor tissue and plant cells (e.g., single cells, protoplasts, embryos, and callus tissue). Plant cells include, without limitation, cells from seeds, suspension cultures, embryos, meristematic regions, callus tissue, leaves, roots, shoots, stems, gametophytes, sporophytes, pollen and microspores. The plant tissue may be in a plant or in a plant organ, tissue or cell culture. A plant of the present invention can be a plant whose individual cells will support replication and expression of genes from the TMV-based vector. This may be either a dicot plant or a monocot plant. In some embodiments, the plant belongs to the family of Solanaceae. In some embodiments, the plant belongs to the subfamily of Cestroideae (Browallioideae), Goetzeoideae, Petunioideae, Schizanthoideae, Schwenckioideae, Nicotianoideae, or Solanoideae. In some embodiments, the plant belongs to the genus of *Solanum, Lycianthes, Cestrum, Nolana, Physalis, Lycium, Nicotiana, Capsiceae, Brunfelsia*. In some embodiments, the plant is tomato (*S. lycopersicum*), potato (*S. tuberosum*), eggplant (*S. melongena*), pepper (*Capsicum speces*, such as bell pepper, cayenne pepper, chili pepper, pimiento, tabasco pepper, etc.), ground cherry (*Physalis* species, such as *P. peruviana, P. pruninosa,* and *P. philadelphica*, etc.), belladonna (*Atropa belladonna*), henbane (*Hyoscyamus niger*), jimsonweed (*Datura stramonium*), ornamental plants (e.g., angel trumpet, *datura, Nicotiana* species, *S. aviculare, S. capsicastrum, S. crispum, S. laxum, S. pseudocapsicum, S. rantonnetii, S. seaforthianum,* and *S. wendlandii* etc.).

As used herein, the term "tissue culture" indicates a composition comprising isolated cells of the same or a different type or a collection of such cells organized into parts of a plant. Exemplary types of tissue cultures are protoplasts, calli, plant clumps, and plant cells that can generate tissue culture that are intact in plants or parts of plants, such as embryos, pollen, flowers, seeds, leaves, stems, roots, root tips, anthers, pistils, meristematic cells, axillary buds, ovaries, seed coat, endosperm, hypocotyls, cotyledons and the like. The term "plant organ" refers to plant tissue or a group of tissues that constitute a morphologically and functionally distinct part of a plant. "Progeny" comprises any subsequent generation of a plant.

As used herein, the term "host cell" refers to any eukaryotic cell capable of being infected by the recombinant self-replicating RNAs or DNA vectors of the present disclosure. In some embodiments, the present disclosure teaches plant host cells (e.g., "plant host cell" or "plant host"). In some embodiments, the host cells are part of a larger plant organism, such as a cell on the leaf of a plant. In other embodiments, the host cells are isolated in callus tissue, or as protoplasts.

The term "infection" as used herein is broadly used to indicate the introduction of a recombinant self-replicating RNA or DNA vectors of the present disclosure into a plant host. Infection thus includes the ability of a virus to transfer its nucleic acid to a host or the introduction of a viral nucleic acid into a host, such that the viral nucleic acid is replicated, viral proteins are synthesized. Infection however may also comprise inoculation of naked RNA not encapsulated by a viral capsid. Finally, infection, in the context of this application may also refer to the transient expression of sequences from DNA vectors comprising a polynucleotide encoding the recombinant self-replicating RNA of the present disclosure As used herein, the term "self-replicating RNA" or "recombinant self-replicating RNA" refers to an RNA molecule, that can amplify itself and initiate expression and overexpression of heterologous gene products in the host cell. Self-replicating RNA molecules of the invention, unlike mRNA, use their own encoded polymerase/replicase (e.g., a viral polymerase) to amplify themselves. Particular self-replicating RNA molecules of the invention, such as those based on tobacco mosaic viruses, generate large amounts of subgenomic mRNAs from which large amounts of cargo products (proteins or other RNAs) can be expressed. In some embodiments, the recombinant self-replicating RNAs of the present disclosure comprise modified viral RNA genomes. In some embodiments, the recombinant self-replicating RNAs of the present disclosure are based on the genome of the Tobacco Mosaic Virus (TMV). Additional information about recombinant self-replicating RNAs and non-limiting examples are provided in later sections of this document.

As used herein, the term "intercellular movement" refers to the ability of self-replicating RNA to travel from the site of infection to adjacent cells. In some embodiments, the present disclosure teaches methods of intercellular movement via plasmodesmata. In some embodiments, the self-replicating RNAs of the present disclosure can travel 1, 2, 3, 5, 6, 7, 8, 9, 10, 15, 20, 30, 40, 50, 60, 70, 80, 90, 100, 200, 300, 400, 500, 600, 700, or more cells from the site of infection, including are ranges and subranges there between.

Gene editing using tunable nucleases is a powerful tool that is revolutionizing research and biology. The CRISPR/Cas nuclease system in particular is a simple and very efficient critical tool for gene editing. A key challenge in this field is how to deliver the CRISPR/Cas system to living cells.

RNA guided endonucleases (RGEN) are composed of two components: A protein and a 'guide' RNA (gRNA). RGENs like the CRISPR/Cas system are sequence specific DNA cleaving enzymes that can be easily targeted (or 'tuned') to a DNA sequence of interest. The CAS nuclease functions by binding a gRNA and then locating a complementary DNA sequence by RNA-DNA base pairing between the gRNA and a DNA sequence. After binding the CAS, nuclease cleaves both strands of the bound DNA. The CAS nuclease cleavage activity is easily tuned by simply providing a different gRNA to the CAS protein.

Tunable DNA cleaving enzymes like CRISPR/Cas are the key reagent needed for genome engineering or genome editing activities. As a result, the CRISPR/Cas system has triggered an explosion of research activity into the field of genome editing and genome engineering. It is a tool that essentially lets researchers edit or modify plant, animal, insect etc. cell genomes in a targeted manner.

Most methods to date have used transient expression of the Cas9 protein and a guide RNA (the two components of the CRISPR/Cas system) from recombinant DNA molecules. With this approach the recombinant DNAs often (~20% of the time) integrate into the plant genome, making a transgenic insertion. These unintended transgenesis events require that cells be screened to ensure they have no foreign DNA.

One other technical challenge to using the CAS RGEN system is delivering the CAS protein and the gRNA into living cells, and to provide both the Cas9 enzyme and the gRNA from only one single vector.

One way of delivering gRNA into cells that has not been well investigated is delivering gRNA from a plant viral vector. The inventors of the present application look at the feasibility of expressing a functional gRNA from a plant virus vector based on tobacco mosaic virus.

TMV vectors are RNA based expression systems that are easy to construct, can infect a wide range of plant species, quickly move locally and systemically in infected plants (usually systemic in 7-10 days), and generally offer high expression levels of foreign sequences. These attributes may provide virus-based gRNA expression systems with some advantages over current conventional approaches.

Here we disclose the expression of a functional CRISPR/Cas nuclease system from an RNA virus vector based on tobacco mosaic virus. TMV has a genome composed of a single piece of RNA. We have engineered this single RNA genome to express either, or both, the Cas9 protein and guide RNA. Because there is no DNA phase in the virus's life cycle, there is no possibility for transgenic events. Our results indicate the virus expressed CRISPR/Cas system is functional in plants and was used to generate site-specific indel mutations.

Gene Editing

The principles of genome editing rely on natural cellular DNA repair systems. Double-stranded dsDNA breaks introduced by nucleases are repaired by either non-homologous end-joining (NHEJ) or homology-directed repair (HDR).

HDR relies on a template DNA containing sequences homologous to the targeted site to repair the dsDNA break, replacing the break with the sequence on the template DNA (see e.g., Lieber. (2010) Annu. Rev. Biochem. 79: 181-211). Failure to integrate the template DNA however, can result in NHEJ. NHEJ is an error-prone process that is often accompanied by insertion or deletion of nucleotides (indels) at the target site, resulting in genetic knockout (silencing) of the targeted region of the genome due to frameshift mutations or insertions of a premature stop codon (see e.g., Kirk et al., (2000) EMBO J. 19: 5562-5566).

In some embodiments, the present disclosure teaches methods and compositions for gene editing/cloning utilizing DNA nucleases. CRISPR complexes, transcription activator-like effector nucleases (TALENs), zinc finger nucleases (ZFNs), and FokI restriction enzymes are some of the sequence-specific nucleases that have been used as gene editing tools. These enzymes are able to target their nuclease activities to desired target loci through interactions with guide regions engineered to recognize sequences of interest.

In some embodiments, the present disclosure teaches CRISPR-based gene editing methods.

In some embodiments, the present disclosure teaches composition and methods forgene editing utilizing Zinc-finger nucleases (ZFNs). ZFNs are generated by fusing Zinc-finger-based DNA-binding domains to an independent catalytic domain via a flexible linker (Kim. Y. G., J. Cha, et al. (1996). "Hybrid restriction enzymes: zinc finger fusions to Fok I cleavage domain." *Proceedings of the National Academy of Sciences of the United States of America* 93(3): 1156-60; Smith, J., J. M. Berg, et al. (1999). "A detailed study of the substrate specificity of a chimeric restriction enzyme gkc139." *Nucleic Acids Research* 27(2): 674-81; Smith, J., M. Bibikova, et al. (2000). "Requirements for double-strand cleavage by chimeric restriction enzymes with zinc finger DNA-recognition domains." *Nucleic Acids Research* 28(17): 3361-9). The archetypal ZFNs are based on the catalytic domain of the Type IIS restriction enzyme FokI and have been successfully used to induce gene correction, gene insertion, and gene deletion. Zinc Finger-based DNA binding domains are made of strings of 3 or 4 individual Zinc Fingers, each recognizing a DNA triplet (Pabo, C. O., E. Peisach, et al. (2001). "Design and selection of novel Cys2H is 2 zinc finger proteins" *Annual Review of Biochemistry* 70: 313-40). One of the major advantages of ZFNs is that they are easy to design, using combinatorial assembly of preexisting Zinc Fingers with known recognition patterns (Choo, Y. and A. Klug (1994). "Selection of DNA binding sites for zinc fingers using rationally randomized DNA reveals coded interactions." *Proceedings of the National Academy of Sciences of the United States of America* 91(23): 11168-72; Choo, Y. and A. Klug (1994). "Toward a code for the interactions of zinc fingers with DNA: selection of randomized fingers displayed on phage." *Proceedings of the National Academy of Sciences of the United States of America* 91(23): 11163-7; Kim, H. J., H. J. Lee, et al. (2009). "Targeted genome editing in human cells with zinc finger nucleases constructed via modular assembly" *Genome Research* 19(7): 1279-88.). However, close examination of high-resolution structures shows that there are actually cross talks between units (Elrod-Erickson, M., M. A. Rould, et al. (1996). "Zif268 protein-DNA complex refined at 1.6 A: a model system for understanding zinc finger-DNA interactions." *Structure* 4(10): 1171-80), and several methods have been used to assemble ZF proteins by choosing individual Zinc Fingers in a context dependent manner (Greisman, H. A. and C. O. Pabo (1997). "A general strategy for selecting high-affinity zinc finger proteins for diverse DNA target sites." *Science* 275(5300): 657-61: Isalan, M. and Y. Choo (2001). "Rapid, high-throughput engineering of sequence-specific zinc finger DNA-binding proteins" *Methods in Enzymology* 340: 593-609; Maeder. M. L., S. Thibodeau-Beganny, et al. (2008). "Rapid "open-source" engineering of customized zinc-finger nucleases for highly efficient gene modification." *Molecular Cell* 31(2): 294-301.: Ramirez, C. L., J. E. Foley, et al. (2008). "Unexpected failure rates for modular assembly of engineered zinc fingers" Nature Methods 5(5): 374-5) to achieve better success rates and reagents of better quality.

Recently, a new class of chimeric nuclease using a FokI catalytic domain has been described (Christian, M., T. Cermak, t al. (2010). "Targeting DNA double-strand breaks with TAL effector nucleases." *Genetics* 186(2): 757-61.; Li, T., S. Huang, et al. (2011). "TAL nucleases (TALNs): hybrid proteins composed of TAL effectors and FokI DNA-cleavage domain" Nucleic Acids Research 39(1): 359-72.). The DNA binding domain of these nucleases is derived from Transcription Activator Like Effectors (TALE), a family of proteins used in the infection process by plant pathogens of the *Xanthomonas* genus. In these DNA binding domains, sequence specificity is driven by a series of 33-35 amino acids repeats, differing essentially by two positions (Boch, J., H. Scholze, et al. (2009). "Breaking the code of DNA binding specificity of TAL-type III effectors. *Science* 326 (5959): 1509-12; Moscou, M. J. and A. J. Bogdanove (2009). "A simple cipher governs DNA recognition by TAL effectors." *Science* 326(5959): 1501). Each base pair in the DNA target is contacted by a single repeat, with the specificity resulting from the two variant amino acids of the repeat (the so-called repeat variable dipeptide, RVD). The apparent modularity of these DNA binding domains has been confirmed to a certain extent by modular assembly of designed TALE-derived protein with new specificities (Boch, J., H. Scholze, et al. (2009). "Breaking the code of DNA binding specificity of TAL-type III effectors. *Science* 326(5959): 1509-12: Moscou, M. J. and A. J. Bogdanove (2009). "A simple cipher governs DNA recognition by TAL effectors." *Science* 326(5959): 1501).

The functional layout of a FokI-based TALE-nuclease (TALEN) is essentially that of a ZFN, with the Zinc-finger DNA binding domain being replaced by the TALE domain. As such, DNA cleavage by a TALEN requires two DNA recognition regions flanking an unspecific central region. This central "spacer" DNA region is essential to promote catalysis by the dimerizing FokI catalytic domain, and extensive effort has been placed into optimizing the distance between the DNA binding sites. The length of the spacer has been varied from 14 to 30 base pairs, with efficiency in DNA cleavage being interdependent with spacer length as well as TALE scaffold construction (i.e. the nature of the fusion construct used). TALE-nucleases have been shown to be active to various extents in cell-based assays in yeast, mammalian cells and plants (Christian, M., T. Cermak et al. (2010). "Targeting DNA double-strand breaks with TAL effector nucleases." *Genetics* 186(2): 757-61; Li, T., S. Huang, et al. (2011). "TAL nucleases (TALNs): hybrid proteins composed of TAL effectors and FokI DNA-cleavage domain gkq704 [pii] 10. 1093/nar/gkq704." Nucleic Acids Research 39(1): 359-72).

CRISPR Systems

CRISPR (Clustered Regularly Interspaced Short Palindromic Repeats) and CRISPR-associated (Cas) endonucleases were originally discovered as adaptive immunity systems evolved by bacteria and archaea to protect against viral and plasmid invasion. Naturally occurring CRISPR/Cas systems in bacteria are composed of one or more Cas genes and one or more CRISPR arrays consisting of short palindromic repeats of base sequences separated by genome-targeting sequences acquired from previously encountered viruses and plasmids (called spacers). (Wiedenheft, B., et al. Nature. 2012; 482:331; Bhaya, D., et al., Annu. Rev. Genet. 2011; 45:231; and Terms, M. P. et al., Curr. Opin. Microbiol. 2011: 14:321). Bacteria and archaea possessing one or more CRISPR loci, respond to viral or plasmid challenge by integrating short fragments of foreign sequence (protospacers) into the host chromosome at the proximal end of the CRISPR array. Transcription of CRISPR loci generates a library of CRISPR-derived RNAs (crRNAs) containing sequences complementary to previously encountered invading nucleic acids (Haurwitz, R. E., et. al., Science. 2012:329; 1355; Gesner. E. M., et. al., Nat. Struct. Mol. Biol. 2001: 18:688; Jinek, M., et. al., Science. 2012:337; 816-21). Target recognition by crRNAs occurs through complementary base pairing with target DNA, which directs cleavage of foreign sequences by means of Cas proteins. (Jinek et. al. 2012 "A Programmable dual-RNA-guided DNA endonuclease in adaptive bacterial immunity." Science. 2012:337: 816-821).

There are at least five main CRISPR system types (Type I, II, III, IV and V) and at least 16 distinct subtypes (Makarova, K. S., et al., Nat Rev Microbiol. 2015. Nat. Rev. Microbiol. 13, 722-736). CRISPR systems are also classified based on their effector proteins. Class 1 systems possess multi-subunit crRNA-effector complexes, whereas in class 2 systems all functions of the effector complex are carried out by a single protein (e.g., Cas9 or Cpf1). In some embodiments, the present disclosure teaches using type II and/or type V single-subunit effector systems. Thus, in some embodiments, the present disclosure teaches using class 2 CRISPR systems.

CRISPR Cas9

In some embodiments, the present disclosure teaches methods of gene editing using a Type 11 CRISPR system. In some embodiments, the present disclosure teaches Cas9 Type 11 CRISPR systems. Type II systems rely on a i) single endonuclease protein, ii) a transactivating crRNA (tracrRNA), and iii) a crRNA where a 20-nucleotide (nt) portion of the 5' end of crRNA is complementary to a target nucleic acid. The region of a CRISPR crRNA strand that is complementary to its target DNA protospacer is hereby referred to as "guide sequence."

Cas9 endonucleases produce blunt end DNA breaks, and are recruited to target DNA by a combination of a crRNA and a tracrRNA oligos, which tether the endonuclease via complementary hybridization of the RNA complex.

In some embodiments, DNA recognition by the crRNA/endonuclease complex requires additional complementary base pairing with a protospacer adjacent motif (PAM) (e.g., 5'-NGG-3') located in a 3' portion of the target DNA, downstream from the target protospacer. (Jinek, M., et. al., Science. 2012:337; 816-821). In some embodiments, the PAM motif recognized by a Cas9 varies for different Cas9 proteins.

In some embodiments, the Cas9 endonuclease of the present disclosure can include, but is not limited to, one or more of SEQ ID Nos. selected from SEQ ID NO: 1, SEQ ID NO: 2, SEQ ID NO: 3, SEQ ID NO: 4, SEQ ID NO: 5, and SEQ ID NO: 6, and sequences having 60%, 65%, 70%, 75%, 80%, 85%, 90%, 95%, 96%, 97%, 98% or 99% homology with: differs at no more than, 2, 5, 10, 15, 20, 30, or 40% of the amino acid residues when compared with; differs by at least 1, 2, 5, 10 or 20 amino acids but by no more than 100, 80, 70, 60, 50, 40 or 30 amino acids from; or is identical to any Cas9 molecule sequence described herein, or a naturally occurring Cas9 molecule sequence.

Exemplary naturally occurring Cas9 molecules are described in Chylinski et al., RNA Biology 2013 10:5. 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family. For example, Cas9 molecules include, but are not limited to, a Cas9 molecule of: *S. pyogenes* (e.g., strain SF370, MGAS 10270. MGAS 10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC1 1558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F021 1), *S. agalactiae* (e.g., strain NEM316, A909), *Listeria monocytogenes* (e.g., strain F6854), *Listeria innocua* (*L. innocua*, e.g., strain Clip1 1262), *Enterococcus italicus* (e.g., strain DSM 15952), *Enterococcus faecium* (e.g., strain 1,231,408), and *Neisseria meningitidis* (Hou et al., PNAS Early Edition 2013. 1-6). Additional Cas9 molecule is described in WO2015161276, which is herein incorporated by reference in its entirety for all purposes.

In an embodiment, a Cas9 molecule or Cas9 polypeptide of the present disclosure comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*) its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule. e.g., a double stranded or single stranded nucleic acid molecule, can be eliminated.

In an embodiment, a Cas9 molecule or Cas9 polypeptide has the same PAM specificities as a naturally occurring Cas9 molecule. In other embodiments, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes to decrease off target sites and/or improve specificity; or eliminate a PAM recognition requirement. In an embodiment, a Cas9 molecule can be altered, e.g., to increase length of PAM recognition sequence and/or improve Cas9 specificity to high level of identity, e.g., to decrease off target sites and increase specificity. In an embodiment, the length of the PAM recognition sequence is at least 4, 5, 6, 7, 8, 9, 10 or 15 amino acids in length.

CRISPR/Cpf1

In other embodiments, the present disclosure teaches methods of gene editing using a Type V CRISPR system. In some embodiments, the present disclosure teaches methods of using CRISPR from *Prevotella* and *Francisella* 1 (Cpf1).

The Cpf1 CRISPR systems of the present disclosure comprise i) a single endonuclease protein, and ii) a crRNA, wherein a portion of the 3' end of crRNA contains the guide sequence complementary to a target nucleic acid. In this system, the Cpf1 nuclease is directly recruited to the target DNA by the crRNA. In some embodiments, guide sequences for Cpf1 must be at least 12nt, 13nt, 14nt, 15nt, or 16nt in order to achieve detectable DNA cleavage, and a minimum of 14nt, 15nt, 16nt, 17nt, or 18nt to achieve efficient DNA cleavage.

The Cpf1 systems of the present disclosure differ from Cas9 in a variety of ways. First, unlike Cas9, Cpf1 does not require a separate tracrRNA for cleavage. In some embodiments. Cpf1 crRNAs can be as short as about 42-44 bases long, of which 23-25 nts is guide sequence and 19 nt is the constitutive direct repeat sequence. In contrast, the combined Cas9 tracrRNA and crRNA synthetic sequences can be about 100 bases long. In some embodiments, the present disclosure will refer to a crRNA for Cpf1 as a "guide RNA."

Second, Cpf1 prefers a "TTN" PAM motif that is located 5' upstream of its target. This is in contrast to the "NGG" PAM motifs located on the 3' of the target DNA for Cas9 systems. In some embodiments, the uracil base immediately preceding the guide sequence cannot be substituted (Zetsche, B. et al. 2015. "Cpf1 Is a Single RNA-Guided Endonuclease of a Class 2 CRISPR-Cas System" Cell 163, 759-771, which is hereby incorporated by reference in its entirety for all purposes).

Third, the cut sites for Cpf1 are staggered by about 3-5 bases, which create "sticky ends" (Kim et al., 2016. "Genome-wide analysis reveals specificities of Cpf1 endonucleases in human cells" published online Jun. 6, 2016). These sticky ends with ~3-5 nt overhangs are thought to facilitate NHEJ-mediated-ligation, and improve gene editing of DNA fragments with matching ends. The cut sites are in the 3' end of the target DNA, distal to the 5' end where the PAM is. The cut positions usually follow the 18th base on the non-hybridized strand and the corresponding 23rd base on the complementary strand hybridized to the crRNA.

Fourth, in Cpf1 complexes, the "seed" region is located within the first 5 nts of the guide sequence. Cpf1 crRNA seed regions are highly sensitive to mutations, and even single base substitutions in this region can drastically reduce cleavage activity (see Zetsche B. et al. 2015 "Cpf1 Is a Single RNA-Guided Endonuclease of a Class 2 CRISPR-Cas System" Cell 163, 759-771). Critically, unlike the Cas9 CRISPR target, the cleavage sites and the seed region of systems do not overlap. Additional guidance on designing Cpf1 crRNA targeting oligos is available on (Zetsche B. et al. 2015. "Cpf1 Is a Single RNA-Guided Endonuclease of a Class 2 CRISPR-Cas System" Cell 163, 759-771).

Persons skilled in the art will appreciate that the Cpf1 disclosed herein can be any variant derived or isolated from any source. For example, in some embodiments, the Cpf1 peptide of the present disclosure can include one or more of SEQ ID Nos selected from SEQ ID NO: 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, or any variants thereof.

Recombinant Self-Replicating RNA Delivery Systems for Plant Gene Editing, and Uses Thereof In some embodiments, the present disclosure teaches novel compositions and methods for editing the genome of a plant. In some embodiments, said methods comprise the step of introducing into a cell of the plant a recombinant self-replicating RNA as described herein. In some embodiments, said recombinant self-replicating RNA encodes at least one or more genes selected from the group consisting of i) a replicase capable of transcribing the recombinant self-replicating RNA, ii) a movement protein facilitating intercellular movement of the RNA, iii) a Clustered regularly interspaced short palindromic repeats (CRISPR) endonuclease, and iv) at least one guide RNA; wherein said at least one guide RNA is capable of directing sequence-specific binding of the CRISPR endonuclease to target DNA. In some embodiments, said recombinant self-replicating RNA encodes at least iii) a Clustered regularly interspaced short palindromic repeats (CRISPR) endonuclease, and iv) at least one guide RNA; wherein said at least one guide RNA is capable of directing sequence-specific binding of the CRISPR endonuclease to target DNA.

Shortcomings of Traditional Methods of CRISPR Delivery

Traditional vector and protein-based CRISPR gene editing techniques are limited in their ability to quickly and effectively produce non-transgenic gene edits in plants.

Most plant CRISPR gene edits today are conducted by transiently expressing CRISPR endonuclease and guide RNA vectors in plant cells (see Bortesi and Fischer, "The CRISPR/Cas9 system for plant genome editing and beyond", Biotech Advances, Vol 33(1). (2015)). This approach, while amenable for use in laboratory settings, is not sufficiently simple, reliable, and cost-effective for commercial use.

One of the downsides of traditional CRISPR delivery methods is that they often (in about 20% of transformants) result in the insertion of CRISPR-encoding DNA components into the cell. Even transient expressions of CRISPR endonuclease or guide RNA vectors run the significant risk of forming transgenic events and integrating into the genome of the host plant organism. These insertions are often random, and can result in deleterious effects on plant growth and development through the disruption of critical host genes or regulatory sequences.

Permanent integration of CRISPR into the genome of the host plant can also result in the continued expression of the CRISPR endonuclease in commercial products. Integration of either the CRISPR endonuclease, or guide RNA vectors can also result in different regulatory treatment of the final genetically modified organism (for an explanation of the regulatory differences between gene edited, and transgenic organisms (see Jones, H. D. Regulatory uncertainty over genome editing. Nat. Plants 1, 14011 (2015)).

Another downside to traditional CRISPR methods is that they often rely on legacy DNA transformation techniques to deliver the critical CRISPR endonuclease and guide RNA vectors to the plant. This limits the applicability of CRISPR gene editing tools on transformation-recalcitrant plants, such as wheat, soybean, sorghum, cotton, and woody plants. CRISPR delivery systems requiring *agrobacterium* for example, are limited by the host range of the agro-organism (see FIG. 2).

Traditional DNA vector-based CRISPR delivery systems can also be slow and expensive to implement. They often require expensive equipment and facilities, and moreover often require extensive screening and regeneration steps to produce a fully edited plant. Plants transformed with vectors encoding the CRISPR endonuclease and guide RNA will only express the CRISPR components on the cells that were directly transformed. That is. DNA plasmid vectors lack the ability to spread to other neighboring cells. In addition, expression of CRISPR components from non-replicating plasmid vectors is very transient in nature, which can reduce the efficiency of DNA cleavage and DNA editing. As a result, traditional CRISPR delivery systems are only able to produce the intended gene edits in the cells that were directly transformed with the necessary vectors. This requires users to screen hundreds or thousands of cells in order to identify edited cells, which must then go through several regeneration steps in order to recover a fully edited plant (see FIG. 1).

Newly developed techniques have achieved CRISPR gene editing by delivering pre-assembled CRISPR complexes into plant protoplasts, thus reducing the chance of unintended DNA transgenesis. These techniques however, still suffer from severe technical challenges as the isolation and culture of protoplasts is time consuming and expensive. Moreover, regeneration of plants from protoplasts is still not feasible in most plants, including most of the major crop plants in production (see FIG. 1A).

In some embodiments, the present disclosure teaches methods for plant CRISPR gene editing that overcome many of the limitations associated with the traditional techniques described above. In some embodiments, the present disclosure also teaches compositions, RNAs, vectors, and kits for use with the methods of the present invention.

Viruses

In some embodiments, the present disclosure teaches recombinant self-replicating RNA molecules. In some embodiments, the self-replicating RNA molecules of the present disclosure are derived from a virus. In some embodiments, the self-replicating RNA molecules of the present disclosure are derived from a plant virus. In some embodiments, the self-replicating RNA molecules of the present disclosure are derived from an RNA plant virus.

Tobacco Mosaic Virus Group

In some embodiments, the self-replicating RNAs of the present disclosure are derived from Tobacco Mosaic virus (TMV). TMV is a member of the Tobamoviruses. The TMV virion is a tubular filament, and comprises coat protein sub-units arranged in a single right-handed helix with the single-stranded RNA intercalated between the turns of the helix. TMV infects tobacco as well as other plants. TMV is transmitted mechanically and may remain infective for a year or more in soil or dried leaf tissue.

The TMV virions may be inactivated by subjection to an environment with a pH of less than 3 or greater than 8, or by formaldehyde or iodine. Preparations of TMV may be obtained from plant tissues by $(NH_4)_2SO_4$ precipitation, followed by differential centrifugation.

The TMV single-stranded RNA genome is about 6400 nucleotides long, and is capped at the 5' end but not polyadenylated. The genomic RNA can serve as mRNA for a protein of a molecular weight of about 130,000 (130K) and another produced by read-through of molecular weight about 180.000 (180K). However, it cannot function as a messenger for the synthesis of coat protein. Other genes are expressed during infection by the formation of monocistronic, 3'-coterminal sub-genomic mRNAs, including one (LMC) encoding the 17.5K coat protein and the movement protein.

TMV assembly occurs in plant cell cytoplasm, although it has been suggested that some TMV assembly may occur in chloroplasts since transcripts of ctDNA have been detected in purified TMV virions. Initiation of TMV assembly occurs by interaction between ring-shaped aggregates ("discs") of coat protein (each disc consisting of two layers of 17 subunits) and a unique internal nucleation site in the RNA; a hairpin region about 900 nucleotides from the 3' end in the common strain of TMV. Any RNA, including subgenomic RNAs containing this site, may be packaged into virions. The discs apparently assume a helical form on interaction with the RNA, and assembly (elongation) then proceeds in both directions (but much more rapidly in the 3'- to 5'-direction from the nucleation site).

Another member of the Tobamoviruses, the Cucumber green mottle mosaic virus watermelon strain (CGMMV-W) is related to the cucumber virus. Noru, Y. et al. Virology 45, 577 (1971). The coat protein of CGMMV-W interacts with RNA of both TMV and CGMMV to assemble viral particles in vitro (Kurisu et al., Virology 70:214 (1976)).

Several strains of the tobamovirus group are divided into two subgroups, on the basis of the location of the assembly of origin (Fukuda, M. et al., Proc. Nat. Acad. Sci. USA 78:4231 (1981)). Subgroup 1, which includes the vulgare, OM, and tomato strain, has an origin of assembly about 800-1000 nucleotides from the 3' end of the RNA genome, and outside the coat protein cistron (Lebeurier. G. et al., Proc. Nat. Acad. Sci. USA 74:1913 (1977)), and Fukuda, M. et al., Virology 101:493 (1980)). Subgroup II, which includes CGMMV-W and cornpea strain (Cc) has an origin of assembly about 300-500 nucleotides from the 3' end of the RNA genome and within the coat-protein cistron (Fukuda, M. et al., Virology 101:493 (1980)). The coat protein cistron of CGMMV-W is located at nucleotides 176-661 from the 3' end. The 3' noncoding region is 175 nucleotides long. The origin of assembly is positioned within the coat protein cistron (Meshi, T. et al., Virology 127:52 (1983)).

Self-Replicating RNA Molecules

In some embodiments, the present disclosure teaches RNA-mediated methods of CRISPR gene editing. That is, in some embodiments, the present disclosure teaches methods of delivering CRISPR complexes to plants via RNA polynucleotides. In some embodiments, the present disclosure teaches recombinant self-replicating RNA molecules.

In some embodiments, the RNA polynucleotides encoding for the CRISPR complexes are self-replicating. That is, in some embodiments, the self-replicating RNA molecules of the present disclosure are capable of amplifying themselves in host cells independent of the host's DNA/RNA replication machinery.

In some embodiments, the recombinant self-replicating RNAs of the present disclosure are based on the genomic RNA of RNA viruses, such as plant or animal RNA viruses. In some embodiments, the recombinant self-replicating RNAs of the present disclosure are based on the RNA genome of a plant virus. In some embodiments, the recombinant self-replicating RNAs of the present disclosure are based on the RNA genome of the Tobacco Mosaic Virus (TMV). In some embodiments, the recombinant self-replicating RNAs of the present disclosure are enclosed in a viral capsid.

In some embodiments, the recombinant self-replicating RNAs of the present disclosure are based on the RNA genome of a dsRNA virus such as Amalgaviridae (e.g., Blueberry latent virus, *Rhododendron* virus A, and Southern tomato virus), Endornaviridae, Partitiviridae (e.g., deltapartitivirus and Betapartitivirus), Reoviridae (e.g., Oryzavirus and Maize rough dwarf fijivirus), and/or Curcubit yellow associated virus.

In some embodiments, the recombinant self-replicating RNAs of the present disclosure are based on the RNA genome of a positive sense RNA virus such as Bromoviridae (e.g., Alfalfa mosaic alfamovirus and Broad bean mottle bromovirus), Potyviridae (e.g., Barley mild mosaic bymovirus and Barley yellow mosaic bymovirus), Capilloviruses (e.g., Apple stem grooving capillovirus and Cherry A capillovirus), Carlaviruses (e.g., Blueberry scorch carlavirus and *Chrysanthemum* B carlavirus), Tombusviridae (Bean mild mosaic carmovirus and Cucumber leaf spot carmovirus, Artichoke mottled crinkle tombusvirus and Carnation Italian ringspot tombusvirus), Closteroviruses (e.g., Beet yellow stunt closterovirus and Burdock yellows closterovirus), Comoviridae (e.g., Bean pod mottle comovirus and Broad bean stain comovirus), Rhabdoviridae (e.g., Barley yellow striate mosaic cytorhabdovirus and *Festuca* leaf streak cytorhabdovirus), Dianthoviruses (e.g., Carnation ringspot dianthovirus and Sweet clover necrotic mosaic dianthovirus), Enamoviruses (e.g., Pea enation mosaic enamovirus), Furoviruses (e.g., Beet necrotic yellow vein furovirus and Broad bean necrosis furovirus), Hordeiviruses (e.g., *Anthoxanthum* latent blanching hordeivirus and Barley stripe mosaic hordeivirus), Idaeoviruses (e.g., Raspberry bushy dwarf idaeovirus), Luteoviruse (e.g., Barley yellow dwarf luteovirus and Beet mild yellowing luteovirus). Machlomoviruses (e.g., Maize chlorotic mottle machlomovirus), Macluraviruse (e.g., *Maclura* mosaic macluravirus and *Narcissus* latent macluravirus), Marafiviruses (e.g., Bermuda grass etched-line marafivirus and Maize rayado fino marafivirus), Necroviruses (e.g., Tobacco necrosis necrovirus and Carnation yellow stripe necrovirus), Ourmiaviruse (e.g., Cassava Ivorian bacilliform ourmiavirus and Epirus cherry ourmiavirus), potexvirus (e.g., Cactus X potexvirus and Commelina X potexvirus), Sequiviridae (e.g., Dandelion yellow mosaic sequivirus and Parsnip yellow fleck sequivirus), Sobemoviruses (e.g., Bean southern mosaic sobemovirus and Lucerne transient streak sobemovirus), Tenuiviruses (e.g., Maize stripe tenuivirus and Rice grassy stunt tenuivirus), Tobamoviruses (e.g., Cucumber green mottle mosaic tobamovirus and Frangipani mosaic tobamovirus), Tobraviruses (e.g., Pea early browning tobravirus and Tobacco rattle tobravirus), Trichoviruses (e.g., Apple chlorotic leaf spot trichovirus and *Heracleum* latent trichovirus), Tymoviruses (e.g., Abelia latent tymovirus and Cacao yellow mosaic tymovirus), Umbraviruses (e.g., Bean yellow vein banding umbravirus and Carrot mottle mimic umbravirus), and Varicosaviruses (e.g., Freesia leaf necrosis varicosavirus and Tobacco stunt varicosavirus), In some embodiments, the recombinant self-replicating RNAs of the present disclosure are based on the RNA genome of a tospovirus, such as Tomato spotted wilt virus (TSWV), Bean necrotic mosaic virus, *Capsicum* chlorosis virus, Groundnut bud necrosis virus. Groundnut ringspot virus, Groundnut yellow spot virus, *Impatiens* necrotic spot virus. Iris yellow spot virus, Melon yellow spot virus, Peanut bud necrosis virus, Peanut yellow spot virus, Soybean vein necrosis-associated virus, Tomato chlorotic spot virus, Tomato necrotic ringspot virus, Tomato spotted wilt virus, Tomato yellow ring virus, Tomato zonate spot virus, Watermelon bud necrosis virus, Watermelon silver mottle virus, and Zucchini lethal chlorosis virus. In some embodiments, the recombinant self-replicating RNAs of the present disclosure are based on the RNA genome of a Bromoviridae virus, such as Cucumber mosaic virus (CMV) and Brome mosaic virus (BMV). In some embodiments, the recombinant self-replicating RNAs of the present disclosure are based on the RNA genome of a potyvirus, such as Potato virus Y (PVY), and Plum pox virus (PPV). In some embodiments, the recombinant self-replicating RNAs of the present disclosure are based on the RNA genome of a Caulimoviridae virus, such as Cauliflower mosaic virus (CaMV). In some embodiments, the recombinant self-replicating RNAs of the present disclosure are based on the RNA genome of a Begomovirus, such as African cassava mosaic virus (ACMV). In some embodiments, the recombinant self-replicating RNAs of the present disclosure are based on the RNA genome of a Potexvirus, such as Potato virus X (PVX). In some embodiments, the recombinant self-replicating RNAs of the present disclosure are based on the RNA genome of a Closteroviridae virus, such as Citrus tristeza virus (CTV). In some embodiments, the recombinant self-replicating RNAs of the present disclosure are based on the RNA genome of a Luteoviridae virus, such as Barley yellow dwarf virus (BYDV) and Potato leafroll virus (PLRV). In some embodiments, the recombinant self-replicating RNAs of the present disclosure are based on the RNA genome of a Tombusviridae virus, such as Tomato bushy stunt virus (TBSV). In some embodiments, the recombinant self-replicating RNAs of the present disclosure are not based on the RNA genome of a Tobacco Rattle Virus (TRV). In some embodiments, the recombinant self-replicating RNAs of the present disclosure are not based on the RNA genome of a tobravirus.

The recombinant self-replicating RNAs of the present disclosure are based on the RNA genome of a Tobamovirus species. In some embodiments, the recombinant self-replicating RNAs are derived from Bell pepper mosaic virus (BPeMV), Brugmansia mild mottle virus, Cactus mild mottle virus (CMMoV), Clitoria yellow mottle virus, Cucumber fruit mottle mosaic virus, Cucumber green mottle mosaic virus (CGMMV), Cucumber mottle virus, Frangipani mosaic virus (FrMV), Hibiscus latent Fort Pierce virus (HLFPV), Hibiscus latent Singapore virus (HLSV), Kyuri green mottle mosaic virus, Maracuja mosaic virus (MarMV), Obuda pepper virus (ObPV), Odontoglossum ringspot virus (ORSV), Paprika mild mottle virus, Passion fruit mosaic virus, Pepper mild mottle virus (PMMoV), Rattail cactus necrosis-associated virus (RCNaV), Rehmannia mosaic virus, Ribgrass mosaic virus (HRV), Sammons's Opuntia virus (SOV), Streptocarpus flower break virus, Sunn-hemp mosaic virus (SHMV), Tobacco latent virus, Tobacco mild green mosaic virus, Tomato mosaic virus (ToMV), Tobacco mosaic virus, Tomato mottle mosaic virus, Tropical soda apple mosaic virus, Turnip vein-clearing virus (TVCV), Ullucus mild mottle virus, Wasabi mottle virus (WMoV), Yellow tailflower mild mottle virus, Youcai mosaic virus (YoMV) aka oilseed rape mosaic virus (ORMV), Zucchini green mottle mosaic virus, Beet necrotic yellow vein virus (BNYVV), Chara corallina virus (CCV), *Nicotiana velutina* mosaic virus (NVMV), Peanut clump virus (PCV), Potato mop-top virus (PMTV), Soil-borne wheat mosaic virus (SBWMV). Streptocarpus flower break virus (SFBV), cucumber green mottle mosaic virus (CGMMV), and cucumber fruit mottle mosaic virus (CFMMV).

In some, embodiments, the methods of the present disclosure do not introduce any exogenous DNA into the organisms whose genome is being edited. In this way, the present invention overcomes the shortcomings of the prior art by preventing all unintended DNA transgenic events.

In some embodiments, the recombinant self-replicating RNAs of the present disclosure encode at least one or more genes selected from the group consisting of i) a replicase capable of transcribing the recombinant self-replicating RNA, ii) a movement protein facilitating intercellular movement of the RNA, iii) a CRISPR endonuclease, and iv) at least one guide RNA, wherein said at least one guide RNA is capable of directing sequence-specific binding of the CRISPR endonuclease to a target DNA from a cell to be edited, such as a plant cell. In some embodiments, one or more parts are expressed by a subgenomic promoter operably linked to said gene.

In some embodiments, recombinant self-replicating RNAs of the present disclosure encode at least one or more genes selected from the group consisting of i) a replicase capable of transcribing the RNA, iii) a CRISPR endonuclease, and iv) at least one guide RNA, wherein said at least one guide RNA is capable of directing sequence-specific binding of the CRISPR endonuclease to a target DNA from a cell to be edited, such as a plant cell.

In some embodiments, the recombinant self-replicating RNAs of the present disclosure encode at least one or more genes selected from the group consisting of ii) a movement protein facilitating intercellular movement of the RNA, iii) a CRISPR endonuclease, and iv) at least one guide RNA, wherein said at least one guide RNA is capable of directing sequence-specific binding of the CRISPR endonuclease to a target DNA from a cell to be edited, such as a plant cell.

In some embodiments, the recombinant self-replicating RNAs of the present disclosure encode at least one or more genes selected from the group consisting of i) a replicase capable of transcribing the RNA, ii) a movement protein facilitating intercellular movement of the RNA, and iv) at least one guide RNA, wherein said at least one guide RNA is capable of directing sequence-specific binding of the CRISPR endonuclease to a target DNA from a cell to be edited, such as a plant cell.

In some embodiments, the recombinant self-replicating RNAs of the present disclosure encode at least one or more genes selected from the group consisting of i) a replicase capable of transcribing the RNA, ii) a movement protein facilitating intercellular movement of the RNA, and iii) a CRISPR endonuclease.

In some embodiments, the recombinant self-replicating RNAs of the present disclosure encode at least one or more genes selected from the group consisting of i) a replicase capable of transcribing the RNA and ii) a movement protein facilitating intercellular movement of the RNA In some embodiments, the recombinant self-replicating RNAs of the present disclosure encode at least one or more genes selected from the group consisting of i) a replicase capable of transcribing the RNA and iii) a CRISPR endonuclease.

In some embodiments, the recombinant self-replicating RNAs of the present disclosure encode at least one or more genes selected from the group consisting of i) a replicase capable of transcribing the RNA and iv) at least one guide RNA, wherein said at least one guide RNA is capable of directing sequence-specific binding of the CRISPR endonuclease to a target DNA region from a cell to be edited, such as a plant cell.

In some embodiments, the recombinant self-replicating RNAs of the present disclosure encode at least one or more genes selected from the group consisting of ii) a movement protein facilitating intercellular movement of the RNA and iii) a CRISPR endonuclease.

In some embodiments, the recombinant self-replicating RNAs of the present disclosure encode at least one or more genes selected from the group consisting of ii) a movement protein facilitating intercellular movement of the RNA and iv) at least one guide RNA, wherein said at least one guide RNA is capable of directing sequence-specific binding of the CRISPR endonuclease to a target DNA from a cell to be edited, such as a plant cell.

In some embodiments, the recombinant self-replicating RNAs of the present disclosure encode at least one or more genes selected from the group consisting of iii) a CRISPR endonuclease, and iv) at least one guide RNA, wherein said at least one guide RNA is capable of directing sequence-specific binding of the CRISPR endonuclease to a target DNA from a cell to be edited, such as a plant cell.

In some embodiments, the recombinant self-replicating RNAs of the present disclosure encode at least any combination of the genes selected from the group consisting of: i) a replicase capable of transcribing the recombinant self-replicating RNA, ii) a movement protein facilitating intercellular movement of the RNA, iii) a CRISPR endonuclease, and/or iv) at least one guide RNA, wherein said at least one guide RNA is capable of directing sequence-specific binding of the CRISPR endonuclease to a target DNA from a cell to be edited, such as a plant cell. Accordingly, in some embodiments, the recombinant self-replicating RNAs of the present disclosure encode at least the following genes' combinations:

Combination 1: i) a replicase capable of transcribing the recombinant self-replicating RNA, and ii) a movement protein facilitating intercellular movement of the RNA, Combination 2: i) a replicase capable of transcribing the recombinant self-replicating RNA, iii) a CRISPR endonuclease, Combination 3: i) a replicase capable of transcribing the recombinant self-replicating RNA, and iv) at least one guide RNA, wherein said at least one guide RNA is capable of directing sequence-specific binding of the CRISPR endonuclease to a target DNA from a cell to be edited, such as a plant cell, Combination 4: ii) a movement protein facilitating intercellular movement of the RNA, and iii) a CRISPR endonuclease, Combination 5: ii) a movement protein facilitating intercellular movement of the RNA, and iv) at least one guide RNA, wherein said at least one guide RNA is capable of directing sequence-specific binding of the CRISPR endonuclease to a target DNA from a cell to be edited, such as a plant cell, Combination 6: iii) a CRISPR endonuclease, and iv) at least one guide RNA, wherein said at least one guide RNA is capable of directing sequence-specific binding of the CRISPR endonuclease to a target DNA from a cell to be edited, such as a plant cell, Combination 7: i) a replicase capable of transcribing the recombinant self-replicating RNA, ii) a movement protein facilitating intercellular movement of the RNA, and iii) a CRISPR endonuclease.

Combination 8: i) a replicase capable of transcribing the recombinant self-replicating RNA, ii) a movement protein facilitating intercellular movement of the RNA, and iv) at least one guide RNA, wherein said at least one guide RNA is capable of directing sequence-specific binding of the CRISPR endonuclease to a target DNA from a cell to be edited, such as a plant cell, Combination 9: i) a replicase capable of transcribing the recombinant self-replicating RNA, iii) a CRISPR endonuclease, and iv) at least one guide RNA, wherein said at least one guide RNA is capable of directing sequence-specific binding of the CRISPR endonuclease to a target DNA from a cell to be edited, such as a plant cell, Combination 10: ii) a movement protein facilitating intercellular movement of the RNA, iii) a CRISPR endonuclease, and iv) at least one guide RNA, wherein said at least one guide RNA is capable of directing sequence-specific binding of the CRISPR endonuclease to a target DNA from a cell to be edited, such as a plant cell, Combination 11: i) a replicase capable of transcribing the recombinant self-replicating RNA, ii) a movement protein facilitating intercellular movement of the RNA, iii) a CRISPR endonuclease, and iv) at least one guide RNA, wherein said at least one guide RNA is capable of directing sequence-specific binding of the CRISPR endonuclease to a target DNA from a cell to be edited, such as a plant cell.

The above-disclosed illustrative descriptions of the recombinant self-replicating RNAs teach the use of CRISPR endonucleases. However, in some embodiments, the present disclosure teaches use of any endonuclease capable of inducing a double stranded break at a targeted location. Thus in some embodiments the recombinant self-replicating RNAs of the present disclosure are compatible with TALENS, ZFNs, and other meganucleases.

In some embodiments, the recombinant self-replicating RNAs of the present disclosure do not express a capsid protein (CP). In these situations the virus will not generate virion particles during replication and infection of a plant or plant cell. Virus vectors that do not form virion particles during replication and infection are less likely to inadvertently (unintentionally) spread to other plants. Thus, vectors that do not express a CP can have biocontainment advantages.

Subgenomic Promoters

In some embodiments, the self-replicating RNAs of the present disclosure comprise one or more subgenomic promoter(s) that direct the expression of the CRISPR endonuclease and guide RNA. In some embodiments, the subgenomic promoters are naturally occurring sequences. In some embodiments, the subgenomic promoters are synthetic sequences. In some embodiments, the subgenomic promoters comprise both naturally occurring part and synthetic part. In some embodiments, the subgenomic promoter is derived from virus. In some embodiments, the virus is an RNA virus. In some embodiments, the virus is a plant RNA virus. In some embodiments, the plant viruses include, but are not limited to, Tobacco mosaic virus (TMV), Tomato spotted wilt virus (TSWV), Cucumber mosaic virus (CMV), Potato virus Y (PVY), Cauliflower mosaic virus (CaMV), African cassava mosaic virus (ACMV), Plum pox virus (PPV), Brome mosaic virus (BMV), Potato virus X (PVX), Citrus tristeza virus (CTV), Barley yellow dwarf virus (BYDV), Potato leafroll virus (PLRV) and Tomato bushy stunt virus (TBSV).

In some embodiments, the subgenomic promoter comprise polynucleotide sequence selected from the group consisting of SEQ ID No. 65, 66, and 67. In some embodiments, the subgenomic promoter comprises polynucleotide sequence having at least 70%, 75%, 80%. 85%, 90%, 95%, 96%, 97%, 98%, 99%, or more identity to SEQ ID Nos. 65, 66, or 67.

In some embodiments, the subgenomic promoters are synthetic promoters. In some embodiments, the synthetic subgenomic promoter comprise the polynucleotide sequence of SEQ ID No. 68. In some embodiments, the subgenomic promoter comprise polynucleotide sequence having at least 70%, 75%, 80%, 85%, 90%, 95%, 96%, 97%, 98%, 99%, or more identity to SEQ ID No. 68.

This application provides promoter sequences in their 5'-3' orientation, as they would be placed in a double stranded DNA vector encoding the self-replicating RNA of the present disclosure. However, persons skilled in the art will appreciate that the Coat Protein In some embodiments, the recombinant self-replicating RNAs of the present disclosure encode for a coat protein. In some embodiments, the coat protein assembles into a viral capsid that envelops the self-replicating RNA and facilitates systemic spread of the RNA throughout the host plant.

In some embodiments, the coat protein is derived from an RNA virus. In some embodiments, the virus is a plant RNA virus or an animal RNA virus. In some embodiments, the virus is a plant RNA virus. In some embodiments, the plant viruses include, but are not limited to, Tobacco mosaic virus (TMV), Tomato spotted wilt virus (TSWV). Cucumber mosaic virus (CMV), Potato virus Y (PVY), Cauliflower mosaic virus (CaMV). African cassava mosaic virus (ACMV), Plum pox virus (PPV). Brome mosaic virus (BMV), Potato virus X (PVX), Citrus tristeza virus (CTV), Barley yellow dwarf virus (BYDV), Potato leafroll virus (PLRV) and Tomato bushy stunt virus (TBSV). Thus, in some embodiments, the coat protein is any protein capable of self-assembling and encapsulating the self-replicating RNA.

In some embodiments, the coat protein is encoded by a sequence having SEQ ID No. 75. In some embodiments, the coat protein is encoded by a sequence having at least 70%, 75%, 80%, 85%, 90%, 95%, 96%, 97%, 98%, 99%, or more identity to SEQ ID No. 75. In some embodiments, the coat protein comprises the polypeptide sequence of SEQ ID No. 76. In some embodiments, the coat protein comprises a sequence having at least 70%, 75%, 80%, 85%, 90%, 95%, 96%, 97%, 98%, 99%, or more identity to SEQ ID No. 76.

In some embodiments, the recombinant self-replicating RNAs of the present disclosure can function without a coat protein. That is, in some embodiments, self-replicating RNAs of the present disclosure do not encode for a functional coat protein.

The present invention is based in part on the inventor's discovery that the recombinant self-replicating RNAs of the present disclosure can continue to operate as naked RNA genomes, and can also traffic between cells without a coat protein. While not wishing to be bound to any one theory, the inventors of the present disclosure believe that the recombinant self-replicating RNAs of the present disclosure are able to transport between plant cells via plant plasmodesmata in the absence of a coat protein.

In some embodiments, the present disclosure teaches self-replicating RNAs that are capable of intercellular movement, but are not capable of systemic spread, within the plant or to other host plants without human intervention. That is, in some embodiments, the recombinant self-replicating RNAs without a coat protein are capable of intercellular travel, but do not introduce themselves into the plant vasculature to become systemic throughout the plant.

Persons having skill in the art may recognize the potential biocontainment benefits of a self-replicating RNA lacking a capsid protein. Naked recombinant self-replicating RNAs without a coat protein for example, also run a lower risk of spread to other plants, as they are not typically capable of being spread by disease vectors. Naked (uncoated) RNAs are subject to rapid degradation by RNAses, which are known to be ubiquitous. In the absence of encapsidation, naked RNAs are easily and rapidly degraded by RNAse contamination. As such infecting plants with naked RNAs requires specific handling. In contrast, a TMV virion particle is so stable it can be easily and accidentally transferred between plants.

CRISPR Endonuclease

In some embodiments, the recombinant self-replicating RNAs of the present disclosure encode for a CRISPR endonuclease. In some embodiments, the present disclosure teaches use of the Cas9 endonuclease.

Persons having skill in the art will appreciate that the Cas9 disclosed herein can, in some embodiments, be any Cas9 variant derived or isolated from any source. For example, in some embodiments, the Cas9 endonuclease of the present disclosure can include one or more of SEQ ID Nos selected from SEQ ID NO: 1, SEQ ID NO: 2, SEQ ID NO: 3, SEQ ID NO: 4, SEQ ID NO: 5, and SEQ ID NO: 6.

In other embodiments, the Cas9 peptide of the present disclosure can include one or more of the mutations described in the literature, including but not limited to the functional mutations described in: Fonfara et al. Nucleic Acids Res. 2014 February; 42(4):2577-90; Nishimasu H. et al. Cell. 2014 Feb. 27; 156(5):935-49: Jinek M. et al. Science. 2012 337:816-21; and Jinek M. et al. Science. 2014 Mar. 14; 343(6176); see also U.S. patent application Ser. No. 13/842,859, filed Mar. 15, 2013, which is hereby incorporated by reference; further, see U.S. Pat. Nos. 8,697,359; 8,771,945; 8,795,965; 8,865,406; 8,871,445; 8,889,356; 8,895,308; 8,906,616; 8,932,814; 8,945,839; 8,993,233; and 8,999,641, which are all hereby incorporated by reference. Thus, in some embodiments, the systems and methods disclosed herein can be used with the wild type Cas9 protein having double-stranded nuclease activity, Cas9 mutants that act as single stranded nickases, or other mutants with modified nuclease activity. For example, in some embodiments, the CRISPR endonucleases of the present disclosure encompass a Nuclear Localization Sequence (NLS).

In other embodiments, the present disclosure teaches methods of gene editing using a Type V CRISPR system. Thus, in some embodiments, the recombinant self-replicating RNAs of the present disclosure comprise a CRISPR endonuclease from *Prevotella* and *Francisella* 1 (Cpf1).

Thus, in some embodiments, the present disclosure teaches an endonuclease Plasmid encoding for a Cpf1 peptide selected from the group consisting of: SEQ ID Nos: 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, or any variants thereof. In some embodiments, the present disclosure teaches an endonuclease plasmid encoding a Cpf1 peptide from *Francisella novicida* U112. In some embodiments, the present disclosure teaches an endonuclease plasmid encoding SEQ ID NO: 7.

Guide RNA

In some embodiments, the recombinant self-replicating RNA having sequence that encodes for a guide RNA. In some embodiments, the guide RNA of the present disclosure comprises two coding regions, encoding for crRNA and tracrRNA, respectively. In other embodiments, the guide RNA is a single guide RNA (sgRNA) synthetic crRNA/tracrRNA hybrid. In other embodiments, the guide RNA is a crRNA for a Cpf1 endonuclease.

Expression of guide RNAs from recombinant self-replicating RNAs require the user to overcome several technical challenges associated with expressing exogenous sequences. The present disclosure discusses these difficulties in a later section. This section describes general guide RNA design.

The guide RNA encoded in the recombinant self-replicating RNA will, in some embodiments, be designed so as to recruit the CRISPR endonuclease to a target DNA region. In some embodiments, the present disclosure teaches methods of identifying viable target CRISPR landing sites, and designing guide RNAs for targeting said sites. For example, in some embodiments, the present disclosure teaches algorithms designed to facilitate the identification of CRISPR landing sites within target DNA regions.

In some embodiments, the present disclosure teaches use of software programs designed to identify candidate CRISPR target sequences on both strands of an input DNA sequence based on desired guide sequence length and a CRISPR motif sequence (PAM, protospacer adjacent motif) for a specified CRISPR enzyme. For example, target sites for Cpf1 from *Francisella novicida* U112, with PAM sequences TTN, may be identified by searching for 5'-TTN-3' both on the input sequence and on the reverse-complement of the input. The target sites for Cpf1 from *Lachnospiraceae bacterium* and *Acidaminococcus* sp., with PAM sequences TTTN (SEQ ID No. 77), may be identified by searching for 5'-TTTN-3' both on the input sequence and on the reverse complement of the input. Likewise, target sites for Cas9 of *S. thermophilus* CRISPR, with PAM sequence NNAGAAW (SEQ ID No. 78), may be identified by searching for 5'-Nx-NNAGAAW-3' both on the input sequence and on the reverse-complement of the input. The PAM sequence for Cas9 of *S. pyogenes* is 5'-NGG-3' (SEQ ID No. 79).

Likewise, target sites for Cas9 of *S. thermophilus* CRISPR, with PAM sequence NGGNG (SEQ ID No. 80), may be identified by searching for 5'-N, -NGGNG-3' both on the input sequence and on the reverse-complement of the input. The value "x" in Nx may be fixed by the program or specified by the user, such as 20.

Since multiple occurrences in the genome of the DNA target site may lead to nonspecific genome editing, after identifying all potential sites, the present disclosure teaches filtering out sequences based on the number of times they appear in the relevant reference genome or modular CRISPR construct. For those CRISPR enzymes for which sequence specificity is determined by a 'seed' sequence (such as the first 5 bp of the guide sequence for Cpf1-mediated cleavage) the filtering step may also account for any seed sequence limitations.

In some embodiments, algorithmic tools can also identify potential off target sites for a particular guide sequence. For example, in some embodiments Cas-Offinder can be used to identify potential offtarget sites for Cpf1 (see Kim et al., 2016. "Genome-wide analysis reveals specificities of Cpf1 endonucleases in human cells" Nature Biotechnology 34, 863-868). Any other publicly available CRISPR design/identification tool may also be used, including for example the Zhang lab crispr.mit.edu tool (see Hsu, et al. 2013 "DNA targeting specificity of RNA guided Cas9 nucleases" Nature Biotech 31, 827-832).

In some embodiments, the user may be allowed to choose the length of the seed sequence. The user may also be allowed to specify the number of occurrences of the seed: PAM sequence in a genome for purposes of passing the filter. The default is to screen for unique sequences. Filtration level is altered by changing both the length of the seed sequence and the number of occurrences of the sequence in the genome. The program may in addition or alternatively provide the sequence of a guide sequence complementary to the reported target sequence(s) by providing the reverse complement of the identified target sequence(s).

In some embodiments, the present disclosure teaches a guide RNA sequence according to SEQ ID NO. 81.

5'(N20)GTTTAGAGCTAGAAATAGCAAGT-TAAAATAAGGCTAGTCCGT TATCAACTT-GAAAAAGTGGCACCGAGTCGGTGCTTTTT-3'(SEQ ID No. 81), where N20 is the 'spacer/guide sequence' sequence which is complementary to the 'proto spacer' sequence in the DNA target. The sequences in bold are the gRNA 'scaffold' for a single stranded gRNA structure, which is recognized by the Cas9 protein. In some embodiments, the guide RNA sequence comprises additional nucleotide sequences on either or both ends when expressed via the recombinant self-replicating RNAs of the present disclosure. These additional sequences may vary depending on which recombinant self-replicating RNA expresses the guide RNA (See Table 2).

Expressing Exogenous Genes from Self-Replicating RNAs

This section of the document discusses challenges involved in the expression of CRISPR complexes from self-replicating RNAs of the present disclosure. In some embodiments, the recombinant self-replicating RNAs of the present disclosure are based on RNA plant viruses or RNA animal viruses. In some embodiments, the recombinant self-replicating RNAs of the present disclosure are based on a tobravirus. In some embodiments, the recombinant self-replicating RNAs of the present disclosure are based on a Tobamovirus. In some embodiments, the recombinant self-replicating RNAs of the present disclosure are derived from Tobacco mosaic virus (TMV). In some embodiments, the recombinant self-replicating RNAs are derived from other Tobamovirus, including but not limited to, Bell pepper mosaic virus (BPeMV), Brugmansia mild mottle virus, Cactus mild mottle virus (CMMoV), Clitoria yellow mottle virus. Cucumber fruit mottle mosaic virus, Cucumber green mottle mosaic virus (CGMMV), Cucumber mottle virus, Frangipani mosaic virus (FrMV), Hibiscus latent Fort Pierce virus (HLFPV), Hibiscus latent Singapore virus (HLSV), Kyuri green mottle mosaic virus, Maracuja mosaic virus (MarMV), Obuda pepper virus (ObPV), Odontoglossum ringspot virus (ORSV). Paprika mild mottle virus, Passion fruit mosaic virus, Pepper mild mottle virus (PMMoV), Rattail cactus necrosis-associated virus (RCNaV), Rehmannia mosaic virus, Ribgrass mosaic virus (HRV), Sammons's Opuntia virus (SOV), Streptocarpus flower break virus, Sunn-hemp mosaic virus (SHMV), Tobacco latent virus, Tobacco mild green mosaic virus, Tomato mosaic virus (ToMV), Tobacco mosaic virus, Tomato mottle mosaic virus, Tropical soda apple mosaic virus, Turnip vein-clearing virus (TVCV), Ullucus mild mottle virus. Wasabi mottle virus (WMoV), Yellow tailflower mild mottle virus. Youcai mosaic virus (YoMV) aka oilseed rape mosaic virus (ORMV), Zucchini green mottle mosaic virus, Beet necrotic yellow vein virus (BNYVV), Chara corallina virus (CCV), *Nicotiana velutina* mosaic virus (NVMV), Peanut clump virus (PCV), Potato mop-top virus (PMTV), Soil-borne wheat mosaic virus (SBWMV), Streptocarpus flower break virus (SFBV), cucumber green mottle mosaic virus (CGMMV), and cucumber fruit mottle mosaic virus (CFMMV).

TMV and the very closely related Tomato mosaic virus (ToMV) are RNA (+) viruses. The viruses both use their parental self-replicating RNA genomes to synthesize complementary RNA (−) strands which serve as templates for the synthesis of progeny full-length positive strands and subgenomic mRNAs containing the above-referenced Movement Protein (MP), Coat Protein (CP), and exogenous CRISPR endonuclease and guide RNA. (Ishikawa et al., "Replication of tobamovirus RNA" *Proc. Jpn. Acad. Ser. B* 80 215-224 (2004); and Ishibashi K. et al., "Interactions between tobamovirus replication proteins and cellular factors: their impacts on virus multiplication" *Mol. Plant Microbe Interact.* 23 1413-1419 (2010)).

CRISPR Endonuclease Expression

The present invention is based in part on the inventor's discovery that viral RNAs could be modified to express exogenous gene sequences. In particular, the present disclosure teaches for the first time, the ability to express a CRISPR endonuclease from a self-replicating viral RNA.

Although other groups had previously disclosed CRISPR editing with viral RNA, these systems were only capable of expressing guide RNAs, and therefore were only effective on transgenic plants already expressing exogenous Cas9 endonuclease (see WO2015189693). Indeed, the authors of WO2015189693 noted in earlier publications that their system was "limited to 2-3 kb, and cannot be used to deliver Cas9 endonuclease into plants." (see page 2 of Ali et al., "Activity and specificity of TRV-mediated gene editing in plants" Plant Signaling and Behavior Vol 10(10) (2015)).

In contrast, the recombinant self-replicating RNAs of the present invention are, in some embodiments, capable of expressing a CRISPR endonuclease in a host cell. In some embodiments, the recombinant self-replicating RNAs of the present disclosure are capable of expressing both the CRISPR endonuclease and a guide RNA.

In some embodiments, the present disclosure also teaches that the recombinant self-replicating RNAs expressing complete CRISPR complexes can be encapsulated in viral capsids. That is, in some embodiments, the present disclosure teaches a viral capsid comprising a recombinant self-replicating RNA encoding for a CRISPR endonuclease and a guide RNA.

Without wishing to be bound to any one theory, the inventors of the present disclosure believe that the coat protein of rod-shaped viruses can assemble into longer viral capsids that accommodate the larger genome of the recombinant self-replicating RNAs disclosed herein.

Guide RNA Expression

Functional guide RNAs can be a single stranded RNA as small as about 100 nucleotides in length. The 5'-about 20 nucleotides of the guide RNA comprises the guide sequence used for RNA-DNA base pairing to the target DNA. The rest of the about 100 nucleotide guide RNA forms a structured "handle" that interacts with the CRISPR endonuclease. Thus, guide RNAs interact with both the target DNA and the CRISPR endonuclease, directing the CRISPR endonuclease cleavage in a sequence specific-manner.

The CRISPR system was originally discovered in bacteria, but has been adapted to function in eukaryotic cells. The guide RNAs made in bacteria do not have a 5' cap structure that would normally be produced from eukaryotic RNA Pol II promoters. When the CRISPR system was first adapted to use in eukaryotic cells special efforts were made to try to generate guide RNAs that were identical to the guide RNAs made in bacteria. For example, most eukaryotic CRISPR systems cassettes are designed so that guide RNAs are expressed from RNA polymerase III promoters to ensure that the final guide RNA product does not have a 5' cap structure. Also, guide RNA expression cassettes are designed to have only one or no 'extra' nucleotides at their 5'- or 3'-ends to maintain the needed guide RNA structure. Precise transcriptional start and terminator sequences are often used to ensure expression length fidelity.

In order to express 'foreign' sequences from a TMV vector the sequence of interest must be placed under the control of a promoter (RNA sequence) which will be recognized by the replicase of the present disclosure (e.g., TMV RNA dependent RNA Polymerase (RDRP) enzyme) and functionally act as a 'start site' (promoter) for transcription by the replicase. Of the subgenomic promoters in TMV, the promoter sequence for the coat protein gene of TMV has been best characterized, and is the strongest promoter in the virus and is therefore a good candidate for driving the expression of foreign sequences in a recombinant self-replicating RNA of the present disclosure. In some embodiments, this subgenomic promoter is mostly but not entirely located upstream of the transcription start site. In some embodiments, the subgenomic promoter sequence extends into the transcribed sequence. As a result part of the promoter sequence becomes transcribed before the transcription of any inserted foreign sequence.

Prior to this study, there had been no attempts to express functional guide RNAs from a TMV-based vector. Guide RNAs expressed from a TMV vector were expected to have a 5' cap structure, as well as a high likelihood of 'extra' nucleotides on the 5' and 3' end of the guide RNA. Therefore, it was completely unknown when these experiments were initiated whether a standard TMV vector could be used to express a functional guide RNA. Experiments in the Example section of this application demonstrate for the first time the feasibility of TMV RNA-based CRISPR complex delivery.

In some embodiments, the guide RNAs of the present disclosure when expressed from a self-replicating RNA as described herein (e.g., a vector derived from the genome of TMV) comprise at least two extra nucleotides at its 5' and/or 3' end than would be expected if the same guide RNA were to be expressed by a RNA Polymerase III in an eukaryotic in vivo expression system. In some embodiments, the guide RNAs comprise about 2, 3, 4, 5, 6, 7, 8, 9, 10, 15, 20, 25, 30, 35, 40, 45, 50, 55, 60, 65, 70, 75, 80, 85, 90, 95, 100, 120, 130, 140, 150, 160, 170, 180, 190, 200, 300, 400, 500, 600, 700, 800, 900, 1000, 1100, 1200, 1300, 1400, 1500 extra nucleotides at their 5' and/or 3' end than would be expected if the same guide RNA were to be expressed by a RNA Polymerase III in an eukaryotic in vivo expression system. The extra nucleotides at the 5' and/or 3' end of the guide RNA is different from would be expected if the same guide RNA were to be expressed using a vector derived from the genome of Tobacco Rattle Virus (TRV).

Codon Optimization

The recombinant self-replicating RNAs of the present disclosure may express one or more exogenous genes. In some embodiments, the exogenous genes encode for one or more proteins. In some embodiments, the present disclosure teaches the codon optimization of exogenous sequences. In other embodiments, the present disclosure teaches codon optimization of otherwise endogenous sequences. That is, in some embodiments, the present disclosure teaches the codon optimization of one or more genes selected from the group consisting of the replicase, the movement protein, the CRISPR endonuclease and the coat protein.

Each expressed genes may contain its own translation start signals, for example, a ribosomal binding site and start (AUG) codon, or it may be inserted in a manner that takes advantage of one or more of these components preexisting in the viral RNA to be modified. Certain structural constraints must be observed to preserve correct translation of the inserted sequence, according to principles well understood in the art. For example, if it is intended that the exogenous coding segment be combined with an endogenous coding segment, the coding segment to be inserted must be inserted in reading frame phase therewith and in the same translational direction.

In some embodiments, the CRISPR endonucleases of the present disclosure are encoded by sequences that are codon optimized for bacterial expression. In some embodiments, the CRISPR-encoding sequences are optimized for expression in the target plant host (e.g., optimized for tobacco or tomato).

Methods for optimizing codons to improve expression in various hosts are known in the art and are described in the literature (see U.S. Pat. App. Pub. No. 2007/0292918, incorporated herein by reference in its entirety). Optimized coding sequences containing codons preferred by a particular eukaryotic host (see also, Murray et al. (1989) Nucl. Acids Res. 17:477-508) can be prepared, for example, to increase the rate of translation or to produce recombinant RNA transcripts having desirable properties, such as a longer half-life, as compared with transcripts produced from a non-optimized sequence.

Protein expression is governed by a host of factors including those that affect transcription, mRNA processing, and stability and initiation of translation. Optimization can thus address any of a number of sequence features of any particular gene. As a specific example, a rare codon induced translational pause can result in reduced protein expression. A rare codon induced translational pause includes the presence of codons in the polynucleotide of interest that are rarely used in the host organism may have a negative effect on protein translation due to their scarcity in the available tRNA pool.

Alternate translational initiation also can result in reduced heterologous protein expression. Alternate translational initiation can include a synthetic polynucleotide sequence inadvertently containing motifs capable of functioning as a ribosome binding site (RBS). These sites can result in initiating translation of a truncated protein from a gene-internal site. One method of reducing the possibility of producing a truncated protein, which can be difficult to remove during purification, includes eliminating putative internal RBS sequences from an optimized polynucleotide sequence.

Repeat-induced polymerase slippage can result in reduced heterologous protein expression. Repeat-induced polymerase slippage involves nucleotide sequence repeats that have been shown to cause slippage or stuttering of DNA polymerase, which can result in frameshift mutations. Such repeats can also cause slippage of RNA polymerase. In an organism with a high G+C content bias, there can be a higher degree of repeats composed of G or C nucleotide repeats. Therefore, one method of reducing the possibility of inducing RNA polymerase slippage includes altering extended repeats of G or C nucleotides.

Interfering secondary structures also can result in reduced heterologous protein expression. Secondary structures can sequester the RBS sequence or initiation codon and have been correlated to a reduction in protein expression. Stem loop structures can also be involved in transcriptional pausing and attenuation. An optimized polynucleotide sequence can contain minimal secondary structures in the RBS and gene coding regions of the nucleotide sequence to allow for improved transcription and translation.

For example, the optimization process can begin by identifying the desired amino acid sequence to be expressed by the host. From the amino acid sequence, a candidate polynucleotide or DNA sequence can be designed. During the design of the synthetic DNA sequence, the frequency of codon usage can be compared to the codon usage of the host expression organism and rare host codons can be removed from the synthetic sequence. Additionally, the synthetic candidate DNA sequence can be modified in order to remove undesirable enzyme restriction sites and add or remove any desired signal sequences, linkers or untranslated regions. The synthetic DNA sequence can be analyzed for the presence of secondary structure that may interfere with the translation process, such as G/C repeats and stem-loop structures.

Silencing Suppressors

Many higher plant forms have multiple built in defense mechanisms designed to reduce the expression of viral titer. In some embodiments, the present disclosure teaches methods of circumventing defense mechanisms and increasing expression of the self-replicating RNA. In some embodiments, the present disclosure teaches co-expression of the recombinant self-replicating RNA with one or more RNA silencing suppressors. In some embodiments, the self-replicating RNA encodes for the silencing suppressor.

More than forty suppressor of RNA silencing proteins have been identified from plant and animal viruses. (Li and Ding, "Virus counterdefense: diverse strategies for evading the RNA-silencing immunity" Annu Rev Microbiol 60, 503-531 (2006): Ruiz-Ferrer and Voinnet, "Roles of plant small RNAs in biotic stress responses" Annu Rev Plant Biol 60, 485-510. (2009)) These suppressor proteins can be categorized according to three, currently-identified mechanisms as follows: (i) suppression of siRNA production (e.g. HC-Pro of Potyviruses) (Llave et al., "Virus-encoded suppressor of posttranscriptional gene silencing targets a maintenance step in the silencing pathway" Proceedings of the National Academy of Sciences of the United States of America 97, 13401-13406 (2000)): (ii) sequestration of siRNAs (e.g. p19 of Tombusviruses) (Lakatos et al., "Molecular mechanism of RNA silencing suppression mediated by p19 protein of tombusviruses" EMBO J 23, 876-884 (2004); Vargason et al., "Size selective recognition of siRNA by an RNA silencing suppressor" Cell 115, 799-811. (2003)); and (iii) Inhibition of systemic silencing (e.g. p25 of Potato virus X) (Voinnet et al., "A viral movement protein prevents spread of the gene silencing signal in *Nicotiana benthamiana*." Cell 103, 157-167. (2000)). A major function of the viral RNA silencing suppressors is to act as dsRNA-binding proteins (Li and Ding, "Virus counterdefense: diverse strategies for evading the RNA-silencing immunity" Annu Rev Microbiol 60, 503-531 (2006), Ruiz-Ferrer and Voinnet, "Roles of plant small RNAs in biotic stress responses" Annu Rev Plant Biol 60, 485-510. (2009)).

Tombusvirus p19 is a suppressor of RNA silencing that binds to 21 nt duplex siRNAs with high affinity and also binds 22 nt dsRNAs, but with lower affinity, p19 has been categorized as suppressing RNA silencing by sequestering 21 nt duplex siRNAs and prevent their incorporation into the RISC. (Lakatos et al., "Molecular mechanism of RNA silencing suppression mediated by p19 protein of tombusviruses" EMBO J 23, 876-884 (2004); Vargason et al., "Size selective recognition of siRNA by an RNA silencing suppressor" Cell 115, 799-811. (2003)).

Expression by Subgenomic Promoters

Following the synthesis of the replicase viral RNA-dependent RNA polymerase (RDRP), the (+) strand RNA of the recombinant self-replicating RNA is copied into a genome-length (−) strand which then serves as a template for the genomic (G) and the subgenomic (SG) (+) strand RNAs. Thus, in some embodiments, the (−) strand RNA contains at least two different promoters, one for the synthesis of G RNA at or near the 3' end, and one or more internal or subgenomic promoters (SGPs). To synthesize a SG RNA, the viral RDRP recognizes and binds to the SGP and initiates transcription (Koev and Miller, A positive-strand RNA virus with three very different subgenomic RNA promoters J. Virol., 74, pp. 5988-5996 (2000)).

In some embodiments, the TMV subgenomic promoter comprises a stem-loop (SL) structure, which is responsible for the replicase/RDRP binding. Without wishing to be bound by any theory, the present inventors hypothesize that the replicase/RDRP recognizes the SL structure (see study of subgenomic promoter binding in BMV in Haasnoot et al. "The Brome mosaic virus subgenomic promoter hairpin is structurally similar to the iron-responsive element and functionally equivalent to the minus-strand core promoter stem-loop C" RNA, 8, pp. 110-122, 2002).

Figure 11:
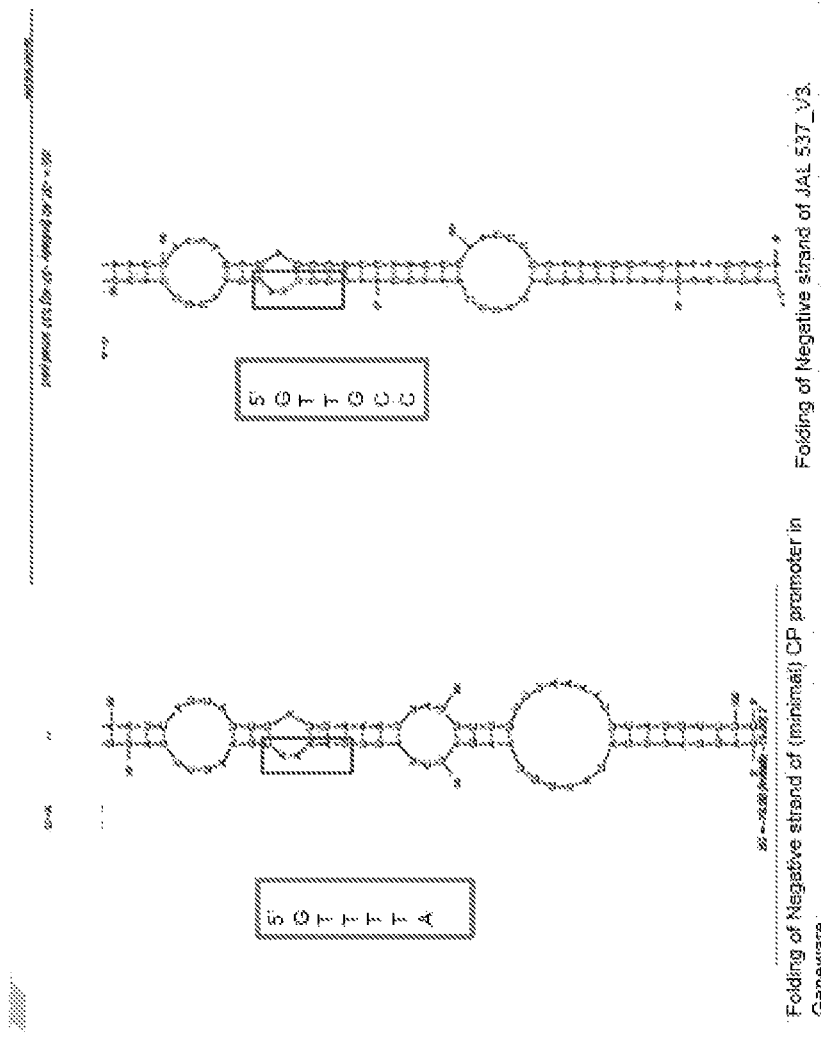
FIG. 11—Depicts folding of negative strand of (minimal) U1 CP subgenomic RNA promoter (based on deletion analysis from Lewandowski et al., from −70 to +30 relative to transcription) and synthetic negative strand of JAL 537_V3 in Geneware. CP mRNA begins with 5' GTTTA. Start of transcribed sequence is boxed in fold. Structures are produced using mFOLD RNA folding software.

In some embodiments, the present disclosure teaches that both the RNA sequence and secondary structures are critical for the activity of an subgenomic promoter (Haasnoot t al., "A conserved hairpin structure in Alfamovirus and Bromovirus subgenomic promoters is required for efficient RNA synthesis in vitro" RNA, 6, pp. 708-716 (2000)). In some embodiments, the subgenomic promoters of the present disclosure will comprise a secondary structure according to (FIG. 11). Persons having skill in the art will be aware of several RNA folding algorithms and software for generating and comparing the stem loop structures of the presently disclosed subgenomic promoters (see e.g., mfold—M. Zuker, "Mfold web server for nucleic acid folding and hybridization prediction" Nucleic Acids Res. 31 (13), 3406-3415. (2003); see also Grdzelishvili et al., "Mapping of the Tobacco Mosaic Virus Movement Protein and Coat Protein Subgenomic RNA Promoters in Vivo" Virology 275, 177-192 (2000) for a discussion on the structural folds of TMV subgenomic promoters).

In some embodiments, the subgenomic promoter comprises polynucleotide sequence selected from the group consisting of SEQ ID No. 65, 66, and 67. In some embodiments, the subgenomic promoter comprises polynucleotide sequence having at least 70%, 75%, 80%, 85%, 90%, 95%, 96%, 97%, 98%, 99%, or more identity to SEQ ID Nos. 65, 66, or 67.

In some embodiments, the subgenomic promoters are synthetic promoters. In some embodiments, the synthetic subgenomic promoter comprises the polynucleotide sequence of SEQ ID No. 68. In some embodiments, the subgenomic promoter comprises polynucleotide sequence having at least 70%, 75%, 80%, 85%, 90%, 95%, 96%, 97%, 98%, 99%, or more identity to SEQ ID No. 68.

Vectors Encoding Recombinant Self-Replicating RNAs

Construction of plant RNA viruses for the introduction and expression in plants of non-viral exogenous nucleic acid sequences can, in some embodiments, be performed as disclosed in U.S. Pat. No. 5,316,931. For example, some TMV-based expression vectors have been described in for example U.S. Pat. No. 8,936,937, each of which is herein incorporated by reference in its entirety.

Necessary parts can be included in order to ensure that the plasmids/vectors of the present disclosure can be amplified and expressed in various cells. In some embodiments for example, the vectors of the present disclosure will comprise one or more of the parts including, but not limited to, at least one origin of replication, one functional resistance marker, and one or more promoter for synthesizing the recombinant self-replicating RNA.

In some embodiments, the present disclosure teaches expression of recombinant self-replicating RNAs from DNA vectors capable of being expressed in plant host cells. In some embodiments, the present disclosure teaches that vectors designed to express in plant cells can express the recombinant self-replicating RNA via any promoter capable of expressing in plants. In some embodiments, the present disclosure teaches use of the CMV 35S promoter, or the T7 promoter, among others.

Thus in some embodiments, the present disclosure teaches the pJL 128 vector. Plasmid pJL 128 contains a T-DNA of a 35S promoter fragment driving a cDNA of the recombinant self-replicating RNA genome. The transcript produced by the 35S promoter will establish self-replication in plant cells, and express the virus proteins for replication, cell to cell movement (the MP protein) and the capsid protein (CP) in addition to the Cas9 CRISPR endonuclease protein (See FIG. 4, and SEQ ID No. 82).

In some embodiments, the present disclosure teaches the pJL 155 vector. Plasmid pJL 155 contains a T-DNA of a 35S promoter fragment driving a cDNA of the recombinant self-replicating RNA genome. The transcript produced by the 35S promoter will establish self-replication in plant cells, and express the virus proteins for replication, cell to cell movement (the MP protein) and the capsid protein (CP) in addition to the guide RNA targeting the PDS gene (See FIG. 5, and SEQ ID No. 83).

In some embodiments, the present disclosure teaches the pJL 165 vector. Plasmid pJL 165 contains a T-DNA of a 35S promoter fragment driving a cDNA of the recombinant self-replicating RNA genome. The transcript produced by the 35S promoter will establish self-replication in plant cells, and express the virus proteins for replication and cell to cell movement (the MP protein) in addition to the Cas9 CRISPR endonuclease protein, and a guide RNA targeting the PDS gene (See FIG. 6, and SEQ ID No. 84).

In some embodiments, the present disclosure teaches expression of recombinant self-replicating RNAs from DNA vectors in exogenous non-host cells, or cell-free mixtures. Thus in some embodiments, the present disclosure teaches vectors comprising any promoters capable of being expressed in non-plant cells or cell free conditions. For example, in some embodiments, the present disclosure teaches production of recombinant self-replicating RNAs by bacteria. In some embodiments, the present disclosure teaches use of the T7 promoter, or the dnaK promoter, among others. A non-limiting list of prokaryotic promoters compatible with the vectors of the present disclosure is provided in http://parts.igem.org/Promoters/Catalog/Ecoli/Constitutive.

In some embodiments, the present disclosure teaches the pJL 186 vector. Plasmid pJL 186 contains a T7 promoter driving a cDNA of the recombinant self-replicating RNA genome, which can be expressed in vitro. The transcript produced by the T7 promoter can be isolated and used to establish self-replication in plant cells, and express the virus proteins for replication and cell to cell movement (the MP protein) in addition to the Cas9 CRISPR endonuclease protein, and a guide RNA targeting the PDS gene (See FIG. 7, and SEQ ID No. 85).

In some embodiments, the present disclosure teaches the pJL 187 vector. Plasmid pJL 187 contains a T7 promoter driving a cDNA of the recombinant self-replicating RNA genome, which can be expressed in vitro. The transcript produced by the T7 promoter can be isolated and used to establish self-replication in plant cells, and express the virus proteins for replication and cell to cell movement (the MP protein) in addition to the Cas9 CRISPR endonuclease protein, and a guide RNA targeting the PDS gene (See FIG. 8, and SEQ ID No. 86).

In some embodiments, the vector encoding a recombinant Self-Replicating RNA of the present invention comprises a 3' UTR sequence which is operably linked to the guide RNA. In some embodiments, the 3' UTR sequence comprises a terminator sequence. In some embodiments, the terminator sequence is CaMV (Cauliflower mosaic virus) 35S terminator.

Methods of Gene Editing Using the RNA Vectors of the Present Disclosure

In some embodiments, the present disclosure teaches a method for editing the genome of a plant, said method comprising the steps of introducing into a cell of the plant a recombinant self-replicating RNA according to the invention. In some embodiments, the genes encoded by the replicating RNA are expressed, and the guide RNA hybridizes to a selected target sequence within the genome of the cell, thereby inducing a double stranded break and resulting in a gene edit at the targeted site.

Thus, in some embodiments, the present disclosure teaches a method for editing the genome of a plant, said method comprising the steps of: a) introducing into a cell of the plant at least one recombinant self-replicating RNA, wherein said recombinant self-replicating RNA encodes at least one or more of the genes selected in the group consisting of: i) a replicase capable of transcribing the recombinant self-replicating RNA; ii) a movement protein facilitating intercellular movement of the RNA, iii) a CRISPR endonuclease; and iv) at least one guide RNA, wherein said at least one guide RNA is capable of directing sequence-specific binding of the CRISPR endonuclease to a target DNA, wherein elements (i), (ii), (iii) and/or (iv) are expressed in the cell, and the CRISPR endonuclease cleaves the cell's genome at the selected target sequence, thereby editing the plant genome.

In some embodiments, said recombinant self-replicating RNA encodes any of the genes combinations as described here above, e.g. any of the genes combinations 1 to 11 as described above. In some embodiments, said recombinant self-replicating RNA encodes at least the genes combination 6 or 9 as described above.

In some embodiments, a plant for genome editing is a plant that is susceptible to the virus from which the recombinant self-replicating RNA is based upon. For example, a plant for genome editing in some embodiments is selected from plants that are susceptible to TMV when the recombinant self-replicating RNA is based upon TMV genome. In some embodiments, such plants include, but are not limited to, *Beta vulgaris, Capsicum frutescens, Chenopodium amaranticolor, Chenopodium hybridum, Chenopodium quinoa, Cucumis melo, Cucumis sativus, Cucurbita pepo, Datura stramonium, Lactuca saliva, Lycopersicon esculentum, Lycopersicon pimpinellifolium, Nicotiana benthamiana, Nicotiarna bigelovii, Nicotiana clevelandii, Nicotiana debnevi, Nicotiana glutinosa, Nicoana rustica, Nicotiana sylvestris. Nicotiana tabacum, Papaver nudicaule, Phaseolus vulgaris, Physalis floridana, Physahs peruviana*, and *Solanum tuberosum*. There may be additional plant species whose cells will support replication of the TMV based vector of the present disclosure, which are also suitable. The viral vector would be useful for gene editing in these plant species as well.

Infecting Plants

In some embodiments, the introducing step of the present disclosure can comprise any known way for introducing polynucleotides into plants. Particular methods include, but are not limited to, calcium phosphate transfection, DEAE-Dextran mediated transfection, lipofection, PEG-mediated transfection, biolistic delivery, and electroporation (Davis, L., Dibner, M., Battey, I., 1986 "Basic Methods in Molecular Biology"). Other methods of transformation include for example, lithium acetate transformation and electroporation See, e.g., Gietz et al., Nucleic Acids Res. 27:69-74 (1992); Ito et al., J. Bacterol. 153:163-168 (1983); and Becker and Guarente, Methods in Enzymology 194:182-187 (1991). In some embodiments, transformed host cells are referred to as recombinant host strains.

In some embodiments, the present disclosure teaches methods of introducing the recombinant self-replicating RNA into a plant cell, said methods comprising i) agro infiltrating a vector encoding the recombinant self-replicating RNA into the plant cell; ii) contacting the recombinant self-replicating RNA with the plant cell; iii) electroporating the recombinant self-replicating RNA, or a DNA sequence encoding the recombinant self-replicating RNA into the plant cell, iv) mechanical inoculation; v) biolistically delivering the recombinant self-replicating RNA, or a DNA sequence encoding the recombinant self-replicating RNA into the plant cell, and/or any combination thereof. Other methods suitable for introducing a polynucleotide sequence into a plant cell can also be used.

Agroinfiltration

For example, in some embodiments, the present disclosure teaches methods of introducing a DNA vector expressing the recombinant self-replicating RNA using *agrobacterium*. Persons having skill in the art will be familiar with common *agrobacterium*-mediated transformation methods. For example, in some embodiments, the present disclosure teaches use of agroinfiltration.

The term "agroinfiltration" as used herein refers to a method in plant biology to induce expression of genes in a plant or to produce a desired protein. In the method, a suspension of *Agrobacterium tumefaciens* is injected into a plant leaf, where it transfers the desired gene (as part of a T-DNA sequence) to plant cells. First step of the protocol is to introduce a gene of interest into a T-DNA portion of an *Agrobacterium* plasmid and introduce the resulting plasmid to a strain of *Agrobacterium*. Subsequently the strain is grown in a liquid culture and the resulting bacteria are washed and suspended into a suitable buffer solution. This solution is then placed in a syringe (without a needle). The tip of the syringe is pressed against the underside of a leaf while simultaneously applying gentle counter pressure to the other side of the leaf. The *Agrobacterium* solution is then injected into the airspaces inside the leaf through stomata, or sometimes through a tiny incision made to the underside of the leaf.

Vacuum infiltration is another way to penetrate *Agrobacterium* deep into plant tissue. In this procedure, leaf disks, leaves, or whole plants are submerged in a beaker containing the solution, and the beaker is placed in a vacuum chamber. The vacuum is then applied, forcing air out of the stomata. When the vacuum is released, the pressure difference forces solution through the stomata and into the mesophyll.

Once inside the leaf the *Agrobacterium* remains in the intercellular space and transfers the gene of interest in high copy numbers into the plant cells. The gene is then transiently expressed (no selection for stable integration is performed). The plant can be monitored for a possible effect in the phenotype, subjected to experimental conditions or harvested and used for purification of the protein of interest. Many plant species can be processed using this method, but the most common ones are *Nicotiana benthamiana* and *Nicotiana tabacum*.

Electroporation

DNA vectors encoding for the recombinant self-replicating RNA of the present disclosure can also be introduced into protoplasts via electroporation or PEG-mediated transformation (see e.g., U.S. Pat. Nos. 9,366,860 and 5,824,857; (M. E. Fromm et al., Nature, 319, 791 (1986); H. Jones et al., Plant Mol. Biol., 13, 501 (1989) and H. Yang et al., Plant Cell Reports, 7, 421 (1988).

In some embodiments, transformation of protoplasts may also require protoplast regeneration. Protocols for regenerating plants are available to skilled practitioners, such as (WO/1995/0266281). In some embodiments, the present disclosure teaches that the self-replicating RNA can be directly electroporated into protoplasts.

Biolistic Delivery

Another direct method, called "biolistic bombardment" or "biolistic delivery", uses ultrafine particles, usually tungsten or gold, that are coated with DNA and then sprayed onto the surface of a plant tissue with sufficient force to cause the particles to penetrate plant cells, including the thick cell wall, membrane and nuclear envelope, but without killing at least some of them (U.S. Pat. Nos. 5,204,253, 5,015,580). A third direct method uses fibrous forms of metal or ceramic consisting of sharp, porous or hollow needle-like projections that literally impale the cells, and also the nuclear envelope of cells. Both silicon carbide and aluminum borate whiskers have been used for plant transformation (Mizmo et al., 2004; Petolino et al., 2000, U.S. Pat. No. 5,302,523 US Application 20040197909) and also for bacterial and animal transformation (Kaepler et al., 1992: Raloff, 1990; Wang, 1995).

Rub Inoculation

In some embodiments, the present disclosure teaches rub-inoculation methods of introducing the recombinant self-replicating RNA according to the invention to a plant host cell. In some embodiments, the present disclosure uses the term "contacting" in reference to the step of infecting a plant cell with a recombinant self-replicating RNA according to the invention. In some embodiments, the "contacting" step comprises rub inoculation. In some embodiments, the present disclosure teaches rub inoculating synthesized RNA (e.g., synthesized in bacteria from T7 promoter vectors). In other embodiments, the present disclosure teaches inoculating the recombinant self-replicating RNA according to the invention by rubbing extracts of purified RNA or macerated extracts from an infected plant. In some embodiments, the inoculated RNA will be naked RNA without a coat protein. In other embodiments, the inoculated RNA will be an RNA-containing virus (e.g., a self-replicating RNA encapsulated in a viral coat). In other embodiments the recombinant self-replicating RNA according to the invention can be packaged in vitro with a purified TMV coat protein preparation (see Smith et al., "Assembly of trans-encapsidated recombinant viral vectors engineered from Tobacco mosaic virus and Semliki Forest virus and their evaluation as immunogens" Virology Volume 358, Issue 2, 20 February, Pages 321-333 (2007)).

Persons having skill in the art will be familiar with the various available rub inoculation protocols. In one embodiment, the present disclosure teaches dissolving the isolated recombinant self-replicating RNA in 0.02 M sodium phosphate buffer (pH 7.2) with about 20 mg of carborundum (320 grit) to serve as an abrasive. In this embodiment, the target plants (approx. 60-day-old) are inoculated by gently rubbing the leaf on the abaxial midrib from leaf tip to leaf base with a piece of cheesecloth soaked in inoculum.

In some embodiments. DNA or RNAs of the present disclosure can be stored at −20 or −80 C in either nuclease free water or nuclease free buffered solutions (e.g., pH 7 thru 8 range) of 10 mM Tris-HCl). In some embodiments, the recombinant self-replicating RNAs of the present disclosure can be stored in pH 7.2+/−0.5 units, 10 mM phosphate buffer free of proteases and nucleases for example.

Mechanical Transformation

In some embodiments, the present disclosure teaches other mechanical methods of plant transformation. For example, in some embodiments, the present disclosure teaches the use of silicon carbide whiskers. In some embodiments, this method involves the mixing of silicon carbine fibers and plant cells with DNA or RNA which one desires to be transferred into the plant cell(s) in a buffer suspension followed by vortexing. The recombinant self-replicating RNA according to the invention or DNA vector according to the invention is introduced via abrasion. In other embodiments, the mechanical plant transformation methods comprise microinjection techniques, such as those disclosed in (Neuhaus et al., "Plant transformation by microinjection techniques" Physiologia Plantarum Vol 79, pp 213-217 May (1990)).

There are other methods reported, and undoubtedly, additional methods will be developed. However, in some embodiments, the efficiencies of each of these indirect or direct methods in introducing foreign DNA or RNA into plant cells is low, making it necessary to use some method for selection of only those cells that have been transformed, and further, allowing growth and regeneration into plants of only those cells that comprise the exogenous DNA or RNA.

Indel Frequency

Methods of the present invention provide a relative high indel (genome editing) frequency in transfected plant cells. In some embodiments, the indel frequency is at least about 1.0%, about 1.5%, about 2.0%, about 2.5%, about 3.0%, about 3.5%, about 4.0%, about 4.5%, about 5.5%, about 6.0%, about 6.5%, about 7.0%, about 7.5%, about 8.0%, about 8.5%, about 9.0%, about 9.5%, about 10%, about 11%, about 12%, about 13%, about 14%, about 15%, about 16%, about 17%, about 18%, about 19%, about 20%, or more.

Regeneration for DNA Transformants

For efficient plant gene editing using DNA vectors, a selection method can be employed such that whole plants are regenerated from a single transformed cell and every cell of the transformed plant carries the DNA of interest. These methods can employ positive selection, whereby a foreign gene is supplied to a plant cell that allows it to utilize a substrate present in the medium that it otherwise could not use, such as mannose or xylose (for example, refer U.S. Pat. Nos. 5,767,378; 5,994,629). More typically, however, negative selection is used because it is more efficient, utilizing selective agents such as herbicides or antibiotics that either kill or inhibit the growth of non-transformed plant cells and reducing the possibility of chimeras.

In some embodiments, plants tissue infected with the recombinant self-replicating RNAs of the present disclosure can be regenerated via standard tissue culture protocols and screened for the desired gene mutations at the guide RNA target site.

In some embodiments, the present disclosure teaches methods of infecting the host plant using previously synthesized recombinant self-replicating RNA of the present disclosure (i.e., not expressing the RNA in the host via DNA vectors). In these embodiments, there is no foreign DNA which ever enters the plant cell and therefore no opportunity for an undesirable transgenic event.

In some embodiments, the recombinant self-replicating RNAs of the present disclosure are not transmitted to seed, so seed collected from regenerated plants should have only indel mutations and no transgene and no recombinant RNA. The resulting plants can be used in research or breeding as desired and appropriate.

No-Regeneration Plant Transformations

In some embodiments, the present disclosure teaches no-regen methods of CRISPR gene editing. In some embodiments, the recombinant self-replicating RNAs of the present disclosure are capable triggering gene editing in a growing plant. In some embodiments, the gene edits introduced into the edited plant via the self-replicating RNAs of the present disclosure are passed on to progeny from seed, thus obviating the requirement for any tissue culture regeneration of transformed cells.

Figure 8:
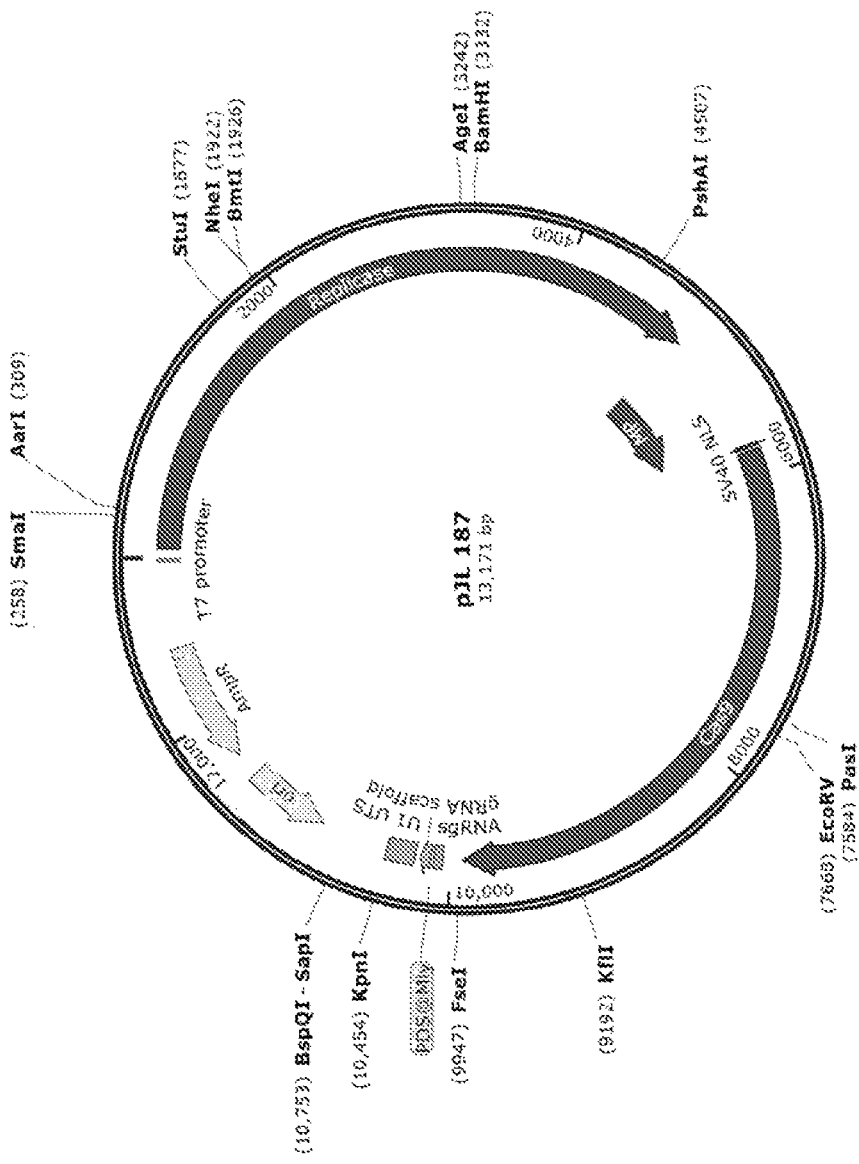
FIG. 8—Vector map of pJL 187 second generation vector, expressing the recombinant self-replicating RNA encoding the CRISPR Cas9 endonuclease and the guide RNA. Functional self-replicating RNA can be produced by in vitro transcription via a T7 promoter, and can then be delivered to plant cells in the absence of any recombinant DNA sequences, if desired. The plasmid p30B (Shivprasad et al 1999. Virology 255, 312-323), which contains a TMV cDNA under the control of a T7 promoter, in a high copy pUC plasmid backbone, was digested with AgeI and KpnI restriction enzymes, and the backbone fragment was isolated. The 7.2 Kb AgeI-KpnI fragment of pJL 165 was then ligated to the vector backbone fragment. The resulting plasmid was called pJL 187.

For example, in some embodiments, a host plant could be edited using the T7 polymerase-produced RNA from pJL 187 vector disclosed herein (see FIG. 8). The pJL 187 vector encodes for a recombinant self-replicating RNA comprising a replicase, a movement protein, a Cas9 CRISPR endonuclease, and a guide RNA capable of hybridizing against a PDS target sequence in a host plant.

Thus, in some embodiments, the recombinant self-replicating RNA is produced in in vitro utilizing the T7 promoter. The synthesized RNA is then isolated and stored for later plant infection.

In some embodiment, the next step is to infect the plant with the recombinant self-replicating RNA. In this case, a rub inoculation would serve to introduce the RNA into the host plant. Other methods for introducing RNA into a plant cell are described in earlier sections of this application, and are also well-known to persons having skill in the art.

Once introduced, the recombinant self-replicating RNA can begin replicating, and can also express the encoded guide RNA and Cas9 protein. These two elements would combine in vivo to form an active CRISPR complex targeted at the PDS gene. Although the pJL 187 vector is designed to target the PDS gene, the vector could be easily modified to target any other gene (see guide RNA design methods discussed supra).

The activated CRISPR complex would cleave the host plant genome DNA generating a knock out (KO) indel mutation in the plant genome at the target location.

In some embodiments, the infected tissue (e.g., a leaf) could be separated from the plant and regenerated into a full plant.

In other embodiments, the recombinant self-replicating RNA according to the invention could be used to infect plant cells that generate germ line cells (e.g., pollen & eggs). In this embodiment, the indel mutation produced from the CRISPR complex would be integrated into germline cells, which would be inherited by progeny plants via the seed.

Thus in some embodiments, the plant recovery step would comprise collecting seed from the previously infected plants. In some embodiments, the recombinant self-replicating RNAs of the present disclosure are not transmitted to seeds. Thus, in some embodiments, the resulting seeds would comprise the designed gene edit, but would no longer comprise the recombinant self-replicating RNA.

In some embodiments, the present invention teaches plants, plant parts, plant cells, and plant progeny produced via the gene editing methods of the disclosure. That is, in some embodiments, the present disclosure teaches plants, plant parts, plant cells, and plant progeny whose genomes have been edited by a recombinant self-replicating RNA, according to the present invention, compared to the parental plants without the gene editing, or to a suitable control plant, such as a wild type plant. In other embodiments, the plants produced by the gene editing methods of the present disclosure comprise about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, or more mutations in its genome compared to that of the parental plants without the genetic editing.

In some embodiments, plants produced by the gene editing methods of the disclosure comprise one or more new desired traits compared to their parental plants without the gene editing, or to a suitable control plant, such as a wild type plant. In some embodiments, the desired trait(s) may be, but not exclusively, due to mutation in a single gene, or multiple genes. In some embodiments, the mutation is a dominant allele. In some embodiments, the mutation is a partially dominant allele. In some embodiments, the mutation is a recessive allele. In some embodiments, the mutation will confer such traits, including but not limited to male sterility, herbicide resistance, insect resistance, resistance for bacterial, fungal, *mycoplasma* or viral disease, enhanced plant quality such as improved drought or salt tolerance, water-stress tolerance, improved standability, enhanced plant vigor, improved shelf life, delayed senescence or controlled ripening, enhanced nutritional quality such as increased sugar content or increased sweetness, increased texture, flavor and aroma, improved fruit length and/or size, protection for color, fruit shape, uniformity, length or diameter, refinement or depth, lodging resistance, yield and recovery, improve fresh cut application, specific aromatic compounds, specific volatiles, flesh texture, specific nutritional components, higher seed yield, higher seed germination, seedling vigor, early maturity, higher fruit yield, ease of fruit setting, etc. For the present invention and the skilled artisan, disease is understood to include, but not limited to fungal diseases, viral diseases, bacterial diseases, mycoplasm diseases, or other plant pathogenic diseases and a disease resistant plant will encompass a plant resistant to fungal, viral, bacterial, mycoplasm, and other plant pathogens.

In some embodiments, the present disclosure teaches edited plants, plant parts, plant cells, and plant progeny. Thus, in some embodiments, the present disclosure teaches plant parts including but not limited to, seeds, fruits, flowers, roots, stems, leaves, embryos, shoots, roots, stems, stipules, petals, flowers, ovules, bracts, branches, petioles, internodes, barks, pubescences, tillers, rhizomes, fronds, blades, ovules, pollens, stamens, and the like, wherein the genome of said plant parts have been edited via the recombinant self-replicating RNAs of the present invention, compared to that of the parental plants without the genetic editing.

In some embodiments, the present disclosure also teaches progeny plants produced by crossing an edited plant according to the present invention with a second plant. In some embodiments, the present disclosure encompasses both the progeny plants themselves, as well as the seeds produced by such a cross. In some embodiments, the progeny can be further screened for plant having one or more mutations that lead to desired phenotypical or morphological characteristics.

In some embodiments, the present disclosure teaches a method for producing a plant seed. The plant seed provided by the method comprises edited genome. In some embodiments, the edited genome has about 1, 2, 3, 4, 5, 6, 7, 8, 9, 10, 15, 20, 25, 30, 35, 40, 45, 50, 55, 60, 65, 70, 75, 80, 85, 90, 95, 100 or more edited loci compared to unedited genome of a check plant (e.g., a wild type plant). In some embodiments, a plant raised from the plant seed have one or more desired phenotypical or morphological characteristics compared to the check plant. In some embodiments, the method comprises crossing a first genetically edited plant produced by the gene editing methods of the present invention with a second plant of the same species. In some embodiments, the second plant is a wild type plant. In some embodiments, the second plant has a desired trait that the first genetically edited plant does not have. In some embodiments, the method comprises crossing a first genetically edited plant produced by the gene editing methods of the present invention with a second genetically edited plant of the same species produced by the gene editing methods of the present invention, and harvesting the resultant seed, wherein the seed comprises the genetic mutations of the first and the second genetically edited plants. In some embodiments, the second genetically edited plant is different from the first genetically edited plant, i.e. second genetically edited plant does not harbor the same mutation that the mutation of the first genetically edited plant. Thus, in some embodiments, the present disclosure comprises methods of stacking traits/mutations from two or more plants. In some embodiments, the present disclosure also teaches resulting progeny plants from crosses between two or more edited plants. In some embodiments, the resulting progeny plants are further screened and selected for plants having the edited locus/loci of the first genetically edited plant, and the desired trait/mutation of the second plant.

In some embodiments, the present disclosure teaches a method for producing a plant progeny, wherein the method comprises crossing the genetically edited plant produced by the gene editing methods of the present invention with a second plant of the same species. In some embodiments, the second plant is different from the genetically edited plant produced by the gene editing methods of the present invention. In some embodiments, the second plant comprises a gene that confers the progeny plant with a phenotype selected from the group consisting of male sterility, male fertility, herbicide resistance, insect resistance, disease resistance, water stress tolerance, and increased digestibility. In some embodiments, the second plant is also a genetically edited plant produced by the gene editing methods of the present invention, but comprising a different mutation than said first genetically edited plant.

In some embodiments, genome knowledge is utilized for targeted genetic alteration of a genome. The guide RNA can be designed to target at least one region of a genome to disrupt that region from the genome. This aspect of the disclosure may be especially useful for genetic alterations. The resulting plant could have a modified phenotype or other property depending on the gene or genes that have been altered. Previously characterized wild-type or mutant alleles can be targeted for CRISPR-mediated modification, enabling creation of improved lines.

In some embodiments, the present disclosure includes methods for inserting a DNA fragment of interest into a specific site of a plant's genome, wherein the DNA fragment of interest is from the genome of the plant or is heterologous with respect to the plant. This disclosure allows one to select or target a particular region of the genome for nucleic acid stacking. A targeted region of the genome may thus display linkage associated with at least one phenotypic trait.

In some embodiments, plants produced by the methods of the present application are used as donors and/or recipients in further breeding program. Also provided are tissue cultures of edited plants, plant parts, or plant cells. Means for preparing and maintaining plant tissue culture are well known in the art. By way of example, a tissue culture comprising organs has been used to produce regenerated plants. U.S. Pat. Nos. 5,959,185, 5,973,234, and 5,977,445 describe certain techniques, the disclosures of which are incorporated herein by reference. In some embodiments, tissue culture of an edited plant can be used for the in vitro regeneration of the edited plants.

As discussed in earlier sections of the disclosure, plants generated by the gene editing methods of the present disclosure can be used for research or breeding as desired and appropriate.

Breeding Methods

Classical breeding methods can be included in the present invention to introduce one or more gene edits created by the CRISPR complexes of the present invention into other plant varieties, or other closely related species that are capable of being crossed with the edited plant of the present invention. Examples of classical breeding methods are described here after in sections i. to xii.

i. Pedigree Selection

Pedigree breeding is used commonly for the improvement of self-pollinating crops or inbred lines of cross-pollinating crops. Two parents possessing favorable, complementary traits are crossed to produce an $F_1$. An $F_2$ population is produced by selfing one or several $F_1$s or by intercrossing two $F_1$s (sib mating). The dihaploid breeding method could also be used. Selection of the best individuals is usually begun in the $F_2$ population; then, beginning in the $F_3$, the best individuals in the best families are selected. Replicated testing of families, or hybrid combinations involving individuals of these families, often follows in the $F_4$ generation to improve the effectiveness of selection for traits with low heritability. At an advanced stage of inbreeding (i.e., $F_6$ and $F_7$), the best lines or mixtures of phenotypically similar lines are tested for potential use as parents of new hybrid cultivars. Similarly, the development of new inbred lines through the dihaploid system requires the selection of the best inbreds followed by two to five years of testing in hybrid combinations in replicated plots.

The single-seed descent procedure in the strict sense refers to planting a segregating population, harvesting a sample of one seed per plant, and using the one-seed sample to plant the next generation. When the population has been advanced from the F2 to the desired level of inbreeding, the plants from which lines are derived will each trace to different F2 individuals. The number of plants in a population declines each generation due to failure of some seeds to germinate or some plants to produce at least one seed. As a result, not all of the F2 plants originally sampled in the population will be represented by a progeny when generation advance is completed.

In a multiple-seed procedure, breeders commonly harvest one or more fruit containing seed from each plant in a population and blend them together to form a bulk seed lot. Part of the bulked seed is used to plant the next generation and part is put in reserve. The procedure has been referred to as modified single-seed descent or the bulk technique.

The multiple-seed procedure has been used to save labor at harvest. It is considerably faster than removing one seed from each fruit by hand for the single seed procedure. The multiple-seed procedure also makes it possible to plant the same number of seeds of a population each generation of inbreeding. Enough seeds are harvested to make up for those plants that did not germinate or produce seed.

Descriptions of other breeding methods that are commonly used for different traits and crops can be found in one of several reference books (e.g., R. W. Allard, 1960. Principles of Plant Breeding, John Wiley and Son. pp. 115-161: N. W. Simmonds. 1979, Principles of Crop Improvement, Longman Group Limited: W. R. Fehr, 1987, Principles of Crop Development, Macmillan Publishing Co.; N. F. Jensen, 1988, Plant Breeding Methodology, John Wiley & Sons).

ii. Backcross Breeding

Backcross breeding has been used to transfer genes for a simply inherited, highly heritable trait into a desirable homozygous cultivar or inbred line, which is the recurrent parent. The source of the trait to be transferred is called the donor parent. The resulting plant is expected to have the attributes of the recurrent parent (e.g., cultivar) and the desirable trait transferred from the donor parent. After the initial cross, individuals possessing the phenotype recurrent parent and the trait of interest from the donor parent are selected and repeatedly crossed (backcrossed) to the recurrent parent. The resulting plant is expected to have the attributes of the recurrent parent (e.g., cultivar) and the desirable trait transferred from the donor parent.

When the term hybrid plant is used in the context of the present invention, this also includes any hybrid plant where one or more desired trait has been introduced through backcrossing methods, whether such trait is a naturally occurring one, a mutant or a nucleotide sequence modified by the use of gene editing or New Breeding Techniques. Backcrossing methods can be used with the present invention to improve or introduce one or more characteristic into the inbred parental line, thus potentially introducing these traits in to the hybrid plant of the present invention. The term "backcrossing" as used herein refers to the repeated crossing of a hybrid progeny back to the recurrent parent, i.e., backcrossing one, two, three, four, five, six, seven, eight, nine, or more times to the recurrent parent. The parental plant that contributes the gene or the genes for the desired characteristic is termed the nonrecurrent or donor parent. This terminology refers to the fact that the nonrecurrent parent is used one time in the backcross protocol and therefore does not recur. The parental plant to which the gene or genes from the nonrecurrent parent are transferred is known as the recurrent parent as it is used for several rounds in the backcrossing protocol.

In a typical backcross protocol, the original inbred of interest (recurrent parent) is crossed to a second inbred (nonrecurrent parent) that carries the gene or genes of interest to be transferred. The resulting progeny from this cross are then crossed again to the recurrent parent and the process is repeated until a plant is obtained wherein all the desired morphological and physiological characteristics of the recurrent parent are recovered in the converted plant, generally determined at a 5% significance level when grown in the same environmental conditions, in addition to the gene or genes transferred from the nonrecurrent parent. It has to be noted that some, one, two, three or more, self-pollination and growing of population might be included between two successive backcrosses. Indeed, an appropriate selection in the population produced by the self-pollination, i.e. selection for the desired trait and physiological and morphological characteristics of the recurrent parent might be equivalent to one, two or even three additional backcrosses in a continuous series without rigorous selection, saving then time, money and effort to the breeder. A non-limiting example of such a protocol would be the following: a) the first generation F1 produced by the cross of the recurrent parent A by the donor parent B is backcrossed to parent A, b) selection is practiced for the plants having the desired trait of parent B, c) selected plant are self-pollinated to produce a population of plants where selection is practiced for the plants having the desired trait of parent B and physiological and morphological characteristics of parent A, d) the selected plants are backcrossed one, two, three, four, five, six, seven, eight, nine, or more times to parent A to produce selected backcross progeny plants comprising the desired trait of parent B and the physiological and morphological characteristics of parent A. Step (c) may or may not be repeated and included between the backcrosses of step (d).

The selection of a suitable recurrent parent is an important step for a successful backcrossing procedure. The goal of a backcross protocol is to alter or substitute one or more trait(s) or characteristic(s) in the original inbred parental line in order to find it then in the hybrid made thereof. To accomplish this, a gene or genes of the recurrent inbred is modified or substituted with the desired gene or genes from the nonrecurrent parent, while retaining essentially all of the rest of the desired genetic, and therefore the desired physiological and morphological, constitution of the original inbred. The choice of the particular nonrecurrent parent will depend on the purpose of the backcross; one of the major purposes is to add some commercially desirable, agronomically important trait(s) to the plant. The exact backcrossing protocol will depend on the characteristic(s) or trait(s) being altered to determine an appropriate testing protocol. Although backcrossing methods are simplified when the characteristic being transferred is a single gene and dominant allele, multiple genes and recessive allele(s) may also be transferred and therefore, backcross breeding is by no means restricted to character(s) governed by one or a few genes. In fact the number of genes might be less important that the identification of the character(s) in the segregating population. In this instance, it may then be necessary to introduce a test of the progeny to determine if the desired characteristic(s) has been successfully transferred. Such tests encompass visual inspection, simple crossing, but also follow up of the characteristic(s) through genetically associated markers and molecular assisted breeding tools. For example, selection of progeny containing the transferred trait is done by direct selection, visual inspection for a trait associated with a dominant allele, while the selection of progeny for a trait that is transferred via a recessive allele, such as the orange fruit color characteristic in tomato, requires selfing the progeny or using molecular markers to determine which plant carry the recessive allele(s).

Many single gene traits have been identified that are not regularly selected for in the development of a new parental inbred of a hybrid plant according to the invention but that can be improved by backcrossing techniques. Examples of these traits include but are not limited to, male sterility (such as the ms1, ms2, ms3, ms4 or ms5 genes), herbicide resistance (such as bar or PAT genes), resistance for bacterial, fungal (genes Cf for resistance to *Cladosporium fulvum*), or viral disease (gene Ty for resistance to Tomato Yellow Leaf Curl Virus (TYLCV), genes Tm-1, Tm-2 and Tm2$^2$ for the resistance to the tomato mosaic tobamovirus (ToMV)), insect resistance (gene Mi for resistance to nematodes), increased brix by introduction of specific alleles such as the hir4 allele from *lycopersicon hirsutum*, high lycopene by using the dg mutant as described in U.S. Ser. No. 10/587, 789, improved shelf life by using mutants such as the rin (ripening inhibitor), nor (non-ripening) or cnr (colorless non ripening) alleles, increased firmness or slower softening of the fruits due, for example in a mutation in an expansin gene, absence of gel (i.e. fruits having a cavity area which is solid and lacks a gel or liquid content male) by the use of the PSAF allele, fertility, enhanced nutritional quality, enhanced sugar content, yield stability and yield enhancement. These genes are generally inherited through the nucleus. Some known exceptions to this are the genes for male sterility, some of which are inherited cytoplasmically, but still act as single gene traits. Several of these single gene traits are described in U.S. Pat. Nos. 5,777,196; 5,948,957 and 5,969,212, the disclosures of which are specifically hereby incorporated by reference.

In 1981, the backcross method of breeding counted for 17% of the total breeding effort for inbred line development in the United States, accordingly to, Hallauer, A. R. et al. (1988) "Corn Breeding" Corn and Corn Improvement, No. 18, pp. 463-481.

The backcross breeding method provides a precise way of improving varieties that excel in a large number of attributes but are deficient in a few characteristics. (Page 150 of the Pr. R. W. Allard's 1960 book, published by John Wiley & Sons, Inc., *Principles of Plant Breeding*). The method makes use of a series of backcrosses to the variety to be improved during which the character or the characters in which improvement is sought is maintained by selection. At the end of the backcrossing the gene or genes being transferred unlike all other genes, will be heterozygous. Selfing after the last backcross produces homozygosity for this gene pair(s) and, coupled with selection, will result in a parental line of a hybrid variety with exactly or essentially the same adaptation, yielding ability and quality characteristics of the recurrent parent but superior to that parent in the particular characteristic(s) for which the improvement program was undertaken. Therefore, this method provides the plant breeder with a high degree of genetic control of his work.

The method is scientifically exact because the morphological and agricultural features of the improved variety could be described in advance and because a similar variety could, if it were desired, be bred a second time by retracing the same steps (Briggs, "Breeding wheats resistant to bunt by the backcross method", 1930 *Jour. Amer. Soc. Agron.*, 22: 289-244).

Backcrossing is a powerful mechanism for achieving homozygosity and any population obtained by backcrossing must rapidly converge on the genotype of the recurrent parent. When backcrossing is made the basis of a plant breeding program, the genotype of the recurrent parent will be theoretically modified only with regards to genes being transferred, which are maintained in the population by selection.

Successful backcrosses are, for example, the transfer of stem rust resistance from 'Hope' wheat to 'Bart wheat' and even pursuing the backcrosses with the transfer of bunt resistance to create 'Bart 38', having both resistances. Also highlighted by Allard is the successful transfer of mildew, leaf spot and wilt resistances in California Common alfalfa to create 'Caliverde'. This new 'Caliverde' variety produced through the backcross process is indistinguishable from California Common except for its resistance to the three named diseases.

One of the advantages of the backcross method is that the breeding program can be carried out in almost every environment that will allow the development of the character being transferred or when using molecular markers that can identify the trait of interest.

The backcross technique is not only desirable when breeding for disease resistance but also for the adjustment of morphological characters, color characteristics and simply inherited quantitative characters such as earliness, plant height and seed size and shape. In this regard, a medium grain type variety, 'Calady', has been produced by Jones and Davis. As dealing with quantitative characteristics, they selected the donor parent with the view of sacrificing some of the intensity of the character for which it was chosen, i.e. of grain size. 'Lady Wright', a long grain variety was used as the donor parent and 'Coloro', a short grain one as the recurrent parent. After four backcrosses, the medium grain type variety 'Calady' was produced.

iii. Open-Pollinated Populations

The improvement of open-pollinated populations of such crops as rye, many maizes and sugar beets, herbage grasses, legumes such as alfalfa and clover, and tropical tree crops such as cacao, coconuts, oil palm and some rubber, depends essentially upon changing gene-frequencies towards fixation of favorable alleles while maintaining a high (but far from maximal) degree of heterozygosity.

Uniformity in such populations is impossible and trueness-to-type in an open-pollinated variety is a statistical feature of the population as a whole, not a characteristic of individual plants. Thus, the heterogeneity of open-pollinated populations contrasts with the homogeneity (or virtually so) of inbred lines, clones and hybrids.

Population improvement methods fall naturally into two groups, those based on purely phenotypic selection, normally called mass selection, and those based on selection with progeny testing. Interpopulation improvement utilizes the concept of open breeding populations; allowing genes to flow from one population to another. Plants in one population (cultivar, strain, ecotype, or any germplasm source) are crossed either naturally (e.g., by wind) or by hand or by bees (commonly *Apis mellifera* L. or *Megachile rotundata* F.) with plants from other populations. Selection is applied to improve one (or sometimes both) population(s) by isolating plants with desirable traits from both sources.

There are basically two primary methods of open-pollinated population improvement. First, there is the situation in which a population is changed en masse by a chosen selection procedure. The outcome is an improved population that is indefinitely propagated by random-mating within itself in isolation.

Second, the synthetic variety attains the same end result as population improvement, but is not itself propagated as such; it has to be reconstructed from parental lines or clones. These plant breeding procedures for improving open-pollinated populations are well known to those skilled in the art and comprehensive reviews of breeding procedures routinely used for improving cross-pollinated plants are provided in numerous texts and articles, including: Allard, *Principles of Plant Breeding*, John Wiley & Sons, Inc. (1960); Simmonds, *Principles of Crop Improvement*, Longman Group Limited (1979); Hallauer and Miranda, *Quantitative Genetics in Maize Breeding*, Iowa State University Press (1981); and, Jensen, *Plant Breeding Methodology*, John Wiley & Sons. Inc. (1988).

A) Mass Selection

Mass and recurrent selections can be used to improve populations of either self- or cross-pollinating crops. A genetically variable population of heterozygous individuals is either identified or created by intercrossing several different parents. The best plants are selected based on individual superiority, outstanding progeny, or excellent combining ability. The selected plants are intercrossed to produce a new population in which further cycles of selection are continued. In mass selection, desirable individual plants are chosen, harvested, and the seed composited without progeny testing to produce the following generation. Since selection is based on the maternal parent only, and there is no control over pollination, mass selection amounts to a form of random mating with selection. As stated above, the purpose of mass selection is to increase the proportion of superior genotypes in the population.

B) Synthetics

A synthetic variety is produced by intercrossing a number of genotypes selected for good combining ability in all possible hybrid combinations, with subsequent maintenance of the variety by open pollination. Whether parents are (more or less inbred) seed-propagated lines, as in some sugar beet and beans (*Vicia*) or clones, as in herbage grasses, clovers and alfalfa, makes no difference in principle. Parents are selected on general combining ability, sometimes by test crosses or topcrosses, more generally by polycrosses. Parental seed lines may be deliberately inbred (e.g. by selfing or sib crossing). However, even if the parents are not deliberately inbred, selection within lines during line maintenance will ensure that some inbreeding occurs. Clonal parents will, of course, remain unchanged and highly heterozygous.

Whether a synthetic can go straight from the parental seed production plot to the farmer or must first undergo one or more cycles of multiplication depends on seed production and the scale of demand for seed. In practice, grasses and clovers are generally multiplied once or twice and are thus considerably removed from the original synthetic.

While mass selection is sometimes used, progeny testing is generally preferred for polycrosses, because of their operational simplicity and obvious relevance to the objective, namely exploitation of general combining ability in a synthetic.

The number of parental lines or clones that enters a synthetic varies widely. In practice, numbers of parental lines range from 10 to several hundred, with 100-200 being the average. Broad based synthetics formed from 100 or more clones would be expected to be more stable during seed multiplication than narrow based synthetics.

iv. Hybrids

A hybrid is an individual plant resulting from a cross between parents of differing genotypes. Commercial hybrids are now used extensively in many crops, including but not limited to corn (maize), sorghum, sugar beet, sunflower, broccoli and tomato. Hybrids can be formed in a number of different ways, including by crossing two parents directly (single cross hybrids), by crossing a single cross hybrid with another parent (three-way or triple cross hybrids), or by crossing two different hybrids (four-way or double cross hybrids).

Strictly speaking, most individuals in an out breeding (i.e., open-pollinated) population are hybrids, but the term is usually reserved for cases in which the parents are individuals whose genomes are sufficiently distinct for them to be recognized as different species or subspecies. Hybrids may be fertile or sterile depending on qualitative and/or quantitative differences in the genomes of the two parents. Heterosis, or hybrid vigor, is usually associated with increased heterozygosity that results in increased vigor of growth, survival, and fertility of hybrids as compared with the parental lines that were used to form the hybrid. Maximum heterosis is usually achieved by crossing two genetically different, highly inbred lines.

Hybrid commercial seed can be produced by controlled hand pollination. The anthers of the female parent are removed and pollen of the male parent is harvested and manually applied to the stigmatic surface of the female inbred. Prior to, and after hand pollination, flowers are covered so that insects do not bring foreign pollen and create a mix or impurity. Flowers are tagged to identify pollinated fruit from which seed will be harvested.

Once the inbreds that give the best hybrid performance have been identified, the hybrid seed can be reproduced indefinitely as long as the homogeneity of the inbred parent is maintained. A single-cross hybrid is produced when two inbred lines are crossed to produce the F1 progeny. A double-cross hybrid is produced from four inbred lines crossed in pairs (A×B and C×D) and then the two F1 hybrids are crossed again (A×B)×(C×D). Much of the hybrid vigor and uniformity exhibited by F I hybrids is lost in the next generation (F2). Consequently, seed from F2 hybrid varieties is not used for planting stock.

The production of hybrids is a well-developed industry, involving the isolated production of both the parental lines and the hybrids which result from crossing those lines. For a detailed discussion of the hybrid production process, see, e.g., Wright, Commercial Hybrid Seed Production 8:161-176, In Hybridization of Crop Plants.

v. Bulk Segregation Analysis (BSA)

BSA, a.k.a. bulked segregation analysis, or bulk segregant analysis, is a method described by Michelmore et al. (Michelmore et al., 1991, Identification of markers linked to disease-resistance genes by bulked segregant analysis: a rapid method to detect markers in specific genomic regions by using segregating populations. *Proceedings of the National Academy of Sciences*, USA, 99:9828-9832) and Quarrie et al. (Quarrie et al., 1999, *Journal of Experimental Botany*, 50(337):1299-1306).

For BSA of a trait of interest, parental lines with certain different phenotypes are chosen and crossed to generate F2, doubled haploid or recombinant inbred populations with QTL analysis. The population is then phenotyped to identify individual plants or lines having high or low expression of the trait. Two DNA bulks are prepared, one from the individuals having one phenotype (e.g., resistant to virus), and the other from the individuals having reversed phenotype (e.g., susceptible to virus), and analyzed for allele frequency with molecular markers. Only a few individuals are required in each bulk (e.g., 10 plants each) if the markers are dominant (e.g., RAPDs). More individuals are needed when markers are co-dominant (e.g., RFLPs, SNPs or SSRs). Markers linked to the phenotype can be identified and used for breeding or QTL mapping.

vi. Hand-Pollination Method

Hand pollination describes the crossing of plants via the deliberate fertilization of female ovules with pollen from a desired male parent plant. In some embodiments the donor or recipient female parent and the donor or recipient male parent line are planted in the same field. The inbred male parent can be planted earlier than the female parent to ensure adequate pollen supply at the pollination time. In some embodiments, the male parent and female parent can be planted at a ratio of 1 male parent to 4-10 female parents. The male parent may be planted at the top of the field for efficient male flower collection during pollination. Pollination is started when the female parent flower is ready to be fertilized. Female flower buds that are ready to open in the following days are identified, covered with paper cups or small paper bags that prevent bee or any other insect from visiting the female flowers, and marked with any kind of material that can be easily seen the next morning. In some embodiments, this process is best done in the afternoon. The male flowers of the male parent are collected in the early morning before they are open and visited by pollinating insects. The covered female flowers of the female parent, which have opened, are un-covered and pollinated with the collected fresh male flowers of the male parent, starting as soon as the male flower sheds pollen. The pollinated female flowers are again covered after pollination to prevent bees and any other insects visit. The pollinated female flowers are also marked. The marked fruits are harvested. In some embodiments, the male pollen used for fertilization has been previously collected and stored.

vii. Bee-Pollination Method

Using the bee-pollination method, the parent plants are usually planted within close proximity. In some embodiments more female plants are planted to allow for a greater production of seed. Breeding of dioecious species can also be done by growing equal amount of each parent plant. Insects are placed in the field or greenhouses for transfer of pollen from the male parent to the female flowers of the female parent.

viii. Targeting Induced Local Lesions in Genomes (TILLING)

Breeding schemes of the present application can include crosses with TILLING plant lines. TILLING® is a method in molecular biology that allows directed identification of mutations in a specific gene. TILLING® was introduced in 2000, using the model plant *Arabidopsis thaliana*. TILLING® has since been used as a reverse genetics method in other organisms such as zebrafish, corn, wheat, rice, soybean, tomato and lettuce.

The method combines a standard and efficient technique of mutagenesis with a chemical mutagen (e.g., Ethyl methanesulfonate (EMS)) with a sensitive DNA screening-technique that identifies single base mutations (also called point mutations) in a target gene. EcoTILLING is a method that uses TILLING® techniques to look for natural mutations in individuals, usually for population genetics analysis (see Comai, et al., 2003 The Plant Journal 37, 778-786; Gilchrist et al. 2006 Mol. Ecol. 15, 1367-1378; Mejlhede et al. 2006 Plant Breeding 125, 461-467: Nieto et al. 2007 BMC Plant Biology 7, 34-42, each of which is incorporated by reference hereby for all purposes). DEcoTILLING is a modification of TILLING® and EcoTILLING which uses an inexpensive method to identify fragments (Garvin et al., 2007, DEcoTILLING: An inexpensive method for SNP discovery that reduces ascertainment bias. Molecular Ecology Notes 7, 735-746).

The TILLING® method relies on the formation of heteroduplexes that are formed when multiple alleles (which could be from a heterozygote or a pool of multiple homozygotes and heterozygotes) are amplified in a PCR, heated, and then slowly cooled. As DNA bases are not pairing at the mismatch of the two DNA strands (the induced mutation in TILLING® or the natural mutation or SNP in EcoTILLING), they provoke a shape change in the double strand DNA fragment, which is then cleaved by single stranded nucleases. The products are then separated by size on several different platforms.

Several TILLING® centers exists over the world that focus on agriculturally important species: UC Davis (USA), focusing on Rice; Purdue University (USA), focusing on Maize; University of British Columbia (CA), focusing on *Brassica napus*; John Innes Centre (UK), focusing on *Brassica rapa*; Fred Hutchinson Cancer Research, focusing on *Arabidopsis*; Southern Illinois University (USA), focusing on Soybean; John Innes Centre (UK), focusing on Lotus and *Medicago*; and INRA (France), focusing on Pea and Tomato.

More detailed description on methods and compositions on TILLING® can be found in U.S. Pat. No. 5,994,075, US 2004/0053236 A1, WO 2005/055704, and WO 2005/048692, each of which is hereby incorporated by reference for all purposes.

Thus in some embodiments, the breeding methods of the present disclosure include breeding with one or more TILLING plant lines with one or more identified mutations.

ix. Mutation Breeding

Mutation breeding is another method of introducing new variation and subsequent traits into plants. Mutations that occur spontaneously or are artificially induced can be useful sources of variability for a plant breeder. The goal of artificial mutagenesis is to increase the rate of mutation for a desired characteristic. Mutation rates can be increased by many different means or mutating agents including temperature, long-term seed storage, tissue culture conditions, radiation (such as X-rays, Gamma rays, neutrons, Beta radiation, or ultraviolet radiation), chemical mutagens (such as base analogs like 5-bromo-uracil), antibiotics, alkylating agents (such as sulfur mustards, nitrogen mustards, epoxides, ethyleneamines, sulfates, sulfonates, sulfones, or lactones), azide, hydroxylamine, nitrous acid or acridines. Once a desired trait is observed through mutagenesis the trait may then be incorporated into existing germplasm by traditional breeding techniques. Details of mutation breeding can be found in W. R. Fehr, 1993, Principles of Cultivar Development. Macmillan Publishing Co.

New breeding techniques such as the ones involving the uses of Zinc Finger Nucleases or oligonucleotide directed mutagenesis shall also be used to generate genetic variability and introduce new traits into varieties.

x. Double Haploids and Chromosome Doubling

One way to obtain homozygous plants without the need to cross two parental lines followed by a long selection of the segregating progeny, and/or multiple backcrossing is to produce haploids and then double the chromosomes to form doubled haploids. Haploid plants can occur spontaneously, or may be artificially induced via chemical treatments or by crossing plants with inducer lines (Seymour et al. 2012, PNAS vol. 109, pg. 4227-4232; Zhang et al., 2008 Plant Cell Rep. December 27(12) 1851-60). The production of haploid progeny can occur via a variety of mechanisms that can affect the distribution of chromosomes during gamete formation. The chromosome complements of haploids sometimes double spontaneously to produce homozygous doubled haploids (DHs). Mixoploids, which are plants which contain cells having different ploidies, can sometimes arise and may represent plants that are undergoing chromosome doubling so as to spontaneously produce doubled haploid tissues, organs, shoots, floral parts or plants. Another common technique is to induce the formation of double haploid plants with a chromosome doubling treatment such as colchicine (El-Hennawy et al., 2011 Vol 56, issue 2 pg. 63-72; Doubled Haploid Production in Crop Plants 2003 edited by Maluszynski ISBN 1-4020-1544-5). The production of doubled haploid plants yields highly uniform inbred lines and is especially desirable as an alternative to sexual inbreeding of longer-generation crops. By producing doubled haploid progeny, the number of possible gene combinations for inherited traits is more manageable. Thus, an efficient doubled haploid technology can significantly reduce the time and the cost of inbred and cultivar development.

xi. Protoplast Fusion

In another method for breeding plants, protoplast fusion can also be used for the transfer of trait-conferring genomic material from a donor plant to a recipient plant. Protoplast fusion is an induced or spontaneous union, such as a somatic hybridization, between two or more protoplasts (cells of which the cell walls are removed by enzymatic treatment) to produce a single bi- or multi-nucleate cell. The fused cell that may even be obtained with plant species that cannot be interbred in nature is tissue cultured into a hybrid plant exhibiting the desirable combination of traits. More specifically, a first protoplast can be obtained from a first plant having the gene edit. A second protoplast can be obtained from a second plant line, optionally from another plant species or variety, preferably from the same plant species or variety, that comprises commercially desirable characteristics, such as, but not limited to disease resistance, insect resistance, valuable grain characteristics (e.g., increased seed weight and/or seed size) etc. In some embodiments, the second protoplast can be obtained from a second plant having a different gene edit than the first protoplast. The protoplasts are then fused using traditional protoplast fusion procedures, which are known in the art to produce the cross.

xii. Embryo Rescue

Alternatively, embryo rescue may be employed in the transfer of resistance-conferring genomic material from a donor plant to a recipient plant. Embryo rescue can be used as a procedure to isolate embryos from crosses to rapidly move to the next generation of backcrossing or selfing or wherein plants fail to produce viable seed. In this process, the fertilized ovary or immature seed of a plant is tissue cultured to create new plants (see Pierik, 1999, *In Vitro Culture of Higher Plants*, Springer, ISBN 079235267x, 9780792352679, which is incorporated herein by reference in its entirety).

xiii. Grafting

Grafting is a process that has been used for many years in crops such as cucurbitacea, but only more recently for tomato and other plants. Grafting may be used to provide a certain level of resistance to telluric pathogens such as *Phytophthora* or to certain nematodes. Grating is therefore intended to prevent contact between the plant or variety to be cultivated and the infested soil. The variety of interest used as the graft or scion, optionally an F I hybrid, is grafted onto the resistant plant used as the rootstock. The resistant rootstock remains healthy and provides, from the soils, the normal supply for the graft that it isolates from the diseases. In some recent developments, it has also been shown that some rootstocks are also able to improve the agronomic value for the grafted plant and in particular the equilibrium between the vegetative and generative development that are always difficult to balance in pepper cultivation.

In some embodiments, said method to introduce one or more gene edits created by the CRISPR complex according to the invention into other plant comprises (i) crossing any one of the plants of the present invention comprising the gene edit as a donor to a recipient plant to create an F1 population; (ii) selecting offspring that have the gene edit. Optionally, the offspring can be further selected by testing for the expression of the gene edit or by sequencing the gene edit.

In some embodiments, complete chromosomes of the donor plant are transferred. For example, the edited plant can serve as a male or female parent in a cross pollination to produce offspring plants, wherein by receiving the gene edit from the donor plant, the offspring plants have the gene edit.

In some embodiments, the recipient plant is an elite line having one or more certain desired traits. Examples of desired traits include but are not limited to those that result in increased biomass production, production of specific chemicals, increased seed production, improved plant material quality, increased seed oil content, etc. Additional examples of desired traits includes pest resistance, vigor, development time (time to harvest), enhanced nutrient content, novel growth patterns, flavors or colors, salt, heat, drought and cold tolerance, and the like. Desired traits also include selectable marker genes (e.g., genes encoding herbicide or antibiotic resistance used only to facilitate detection or selection of transformed cells), hormone biosynthesis genes leading to the production of a plant hormone (e.g., auxins, gibberellins, cytokinins, abscisic acid and ethylene that are used only for selection), or reporter genes (e.g. luciferase, .beta.-glucuronidase, chloramphenicol acetyl transferase (CAT, etc.). The recipient plant can also be a plant with preferred chemical compositions, e.g., compositions preferred for medical use or industrial applications. The recipient plant can also be a plant of the invention comprising a different gene edit than the donor plant.

This invention is further illustrated by the following examples, which should not be construed as limiting. The contents of all references, patents and published patent applications cited throughout this application, as well as the Figures and the Sequence Listing, are incorporated herein by reference.

EXAMPLES

The following examples are given for the purpose of illustrating various embodiments of the disclosure and are not meant to limit the present disclosure in any fashion. Changes therein and other uses which are encompassed within the spirit of the disclosure, as defined by the scope of the claims, will occur to those skilled in the art.

Functional gRNAs can be a single stranded RNA that is as small as about 100 nts. The 5'~20 nts of the gRNA are used for RNA-DNA base pairing, to allow the Cas nuclease to bind a sequence specific DNA target. The rest of the ~100 nt RNA forms a structured "handle" that allows it to bind to the Cas nuclease.

The Cas RGEN system was originally discovered in bacteria, but has been adapted to function in eukaryotic cells. The gRNAs made in bacteria do not have a 5' cap structure (like RNAs that would be made from eukaryotic RNA Pol II promoters), start with the 20 nts needed for RNA-DNA base pairing and have discrete 3' ends. When the CAS RGEN system was first adapted to use in eukaryotic cells special efforts were made to try to generate gRNAs that were identical to the gRNAs made in bacteria. For example in most eukaryotic expression systems for RGENS, in vivo expression cassettes are designed so that gRNAs are expressed from RNA polymerase III promoters so that the gRNA does NOT have a 5' cap structure. Also gRNA expression cassettes are designed to have only one or no 'extra' nts 5' of the 20 nts used for RNA-DNA base pairing, and the 3' ends of the gRNAs have very few nts 3' of the 'handle' sequence used by Cas for gRNA binding.

If a plant viral vector based on TMV is used to express a gRNA the biology of how TMV works as a vector will make it very difficult to make a gRNA that has the same general structure of gRNAs demonstrated to work in eukaryotic cells. For example, a gRNA expressed from a TMV vector will have a 5' cap structure, 'extra' nts on the 5' end and extra nts on the 3' end of the gRNA. These differences may make the gRNA non-functional. Therefore, it was completely unknown when these experiments were initiated whether a standard TMV vector could express a gRNA, which would be functional.

Our hypothesis was that gRNAs could still be functional even if they had a 5' cap and 'extra' nts on both the 5' and 3' ends, that would make them significantly longer than the ~100 nt long gRNAs generally used in genome editing experiments in eukaryotic cells.

Example 1: Develop Rapid System for Assaying CRISPR/Cas Function

To establish a facile system for measuring CRISPR function we reproduced a previously published *Agrobacterium* based transient expression system (Nekrasov et al. "Targeted mutagenesis in the model plant *Nicotiana benthamiana* using Cas9 RNA-guided endonuclease" Nature Biotechnology 8(31): 691-693 (2013)). This system uses separate *Agrobacterium* plasmids containing T-DNAs for expressing either Cas9 protein, driven by the 35S promoter, or the sgRNA, driven by the U6 RNA Pol III promoter. The sgRNA is designed to target the Phytoene desaturase (PDS) locus of *N. benthamiana* at an MlyI restriction endonuclease recognition site (GAGTC)—(SEQ ID No. 87). *Agrobacterium* cultures containing each plasmid are mixed and infiltrated into *N. benthamiana* leaves. Cleavage of the PDS locus by Cas9 will result in indel mutations (caused by error-prone repair of the ds DNA break in the plant) which destroy the MlyI site.

About 2-4 days after agroinfiltration. DNA is extracted from infiltrated leaves. DNA is then digested with the restriction endonuclease MlyI, which will cut any template DNA which has not accumulated an indel mutation due to Cas9 activity. MlyI digested DNA is then used as a template in PCR, with primers that flank the Cas9 targeted MlyI site. The resulting PCR products are cloned and sequenced. Indel mutations at or around the MlyI site in the PDS locus can be easily mapped by DNA sequence analysis.

Figures 3A, 3B:
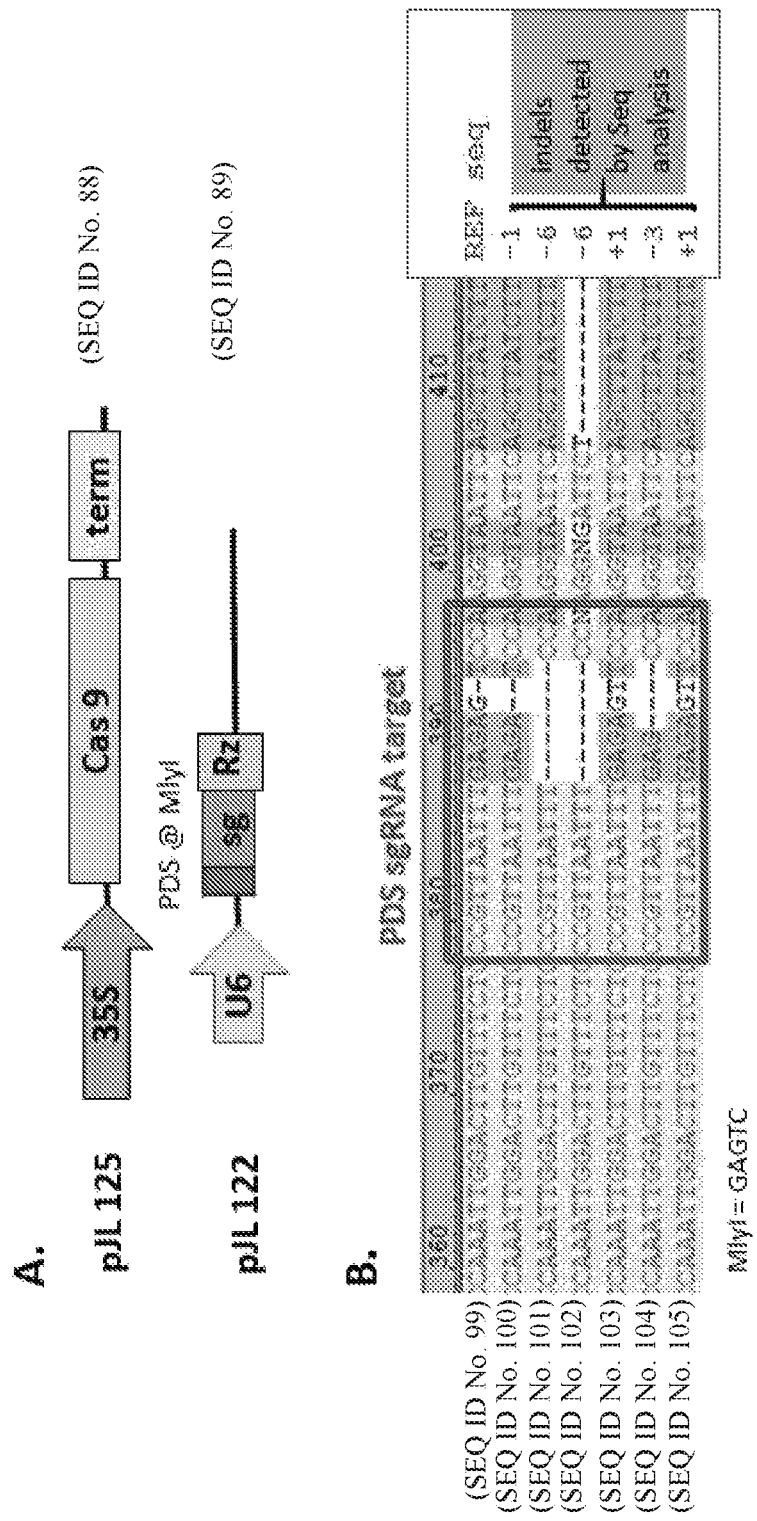
FIG. 3A to FIG. 3B—Illustration of experimental design for tracking plant gene editing.

In constructing vectors for this project, we first obtained Cas9::GFP fusion gene from a mammalian expression vector. Using standard molecular techniques we transferred the Cas9 gene into an *agrobacterium* expression vector under control of the 35S promoter. The resulting plasmid was named pJL 125 (FIG. 3A-SEQ ID No. 88). The sgRNA expression vector was constructed by chemical synthesis of an expression cassette composed of the U6 promoter, PDS sgRNA and terminator from a commercial source. The expression cassette was then transferred into an *Agrobacterium* T-DNA vector using standard molecular techniques, to generate plasmid pJL 122 (FIG. 3A—SEQ ID No. 89).

Experimental Results:

*Agrobacterium* cultures containing pJL 125 or pJL 122 were mixed in equal concentrations, and infiltrated into *N. benthamiana* leaves. About 3-4 days post infiltration, DNA was extracted, digested with MlyI, and used as a template in a PCR using primers that flanked the targeted MlyI site in the PDS locus. Resulting PCR products were cloned into a plasmid vector, and individual clones submitted for DNA sequencing. Alignment of the DNA sequences revealed the presence of multiple, different indels. The results of sequence analysis are presented in (FIG. 3B).

Summary of Results of Example 1

This experiment demonstrated that we had functional clones of Cas9 protein, and sgRNAs that target the PDS locus of *N. benthamiana* at a specific MlyI recognition site. This gave us a set of positive controls, and also a source of reagents for cloning Cas9 ORF and sgRNA sequences into additional expression vector systems, such as the Tobacco Mosaic Virus (TMV) based expression system.

Example 2: Expression of Functional Cas9 Protein from a TMV Vector

Figures 4A, 4B:
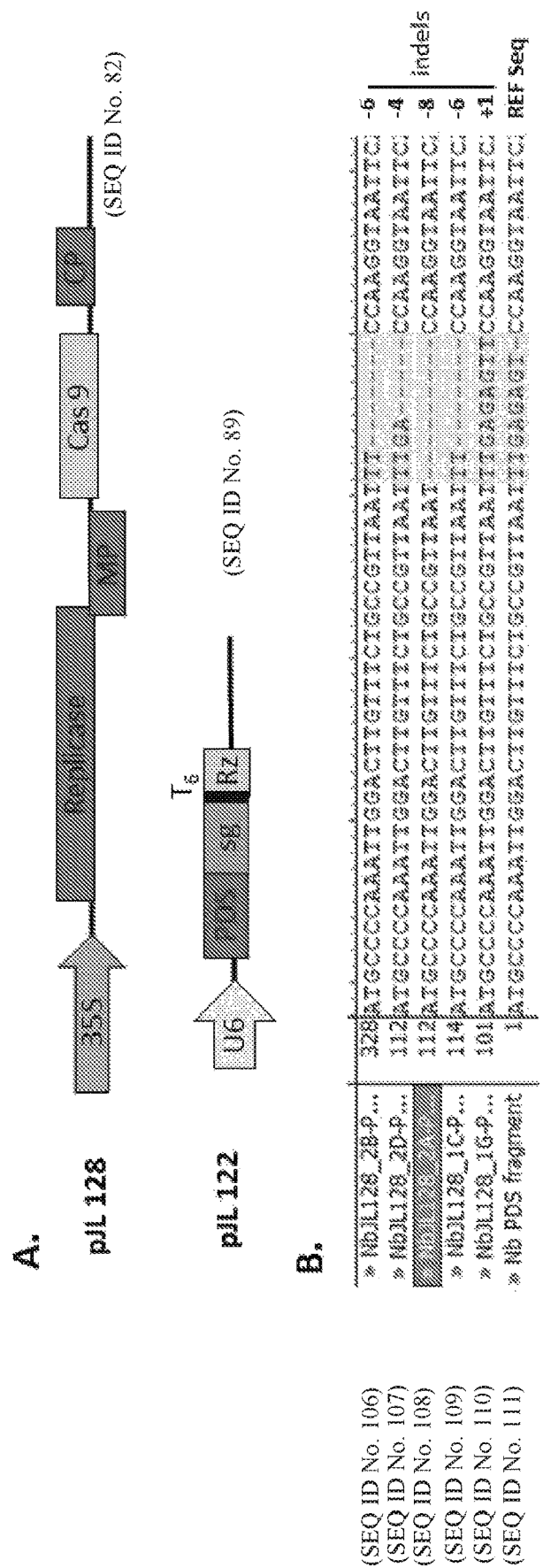
FIG. 4A to FIG. 4B—Illustration of first generation vectors expressing the CRISPR Cas9 endonuclease.

Using standard molecular techniques we inserted the coding sequence for the Cas9 protein into TMV expression vectors to create vector pJL 128 (FIG. 4A—SEQ ID No. 82). This TMV expression vector (cDNA clones) is driven by a 35S promoter. The vector can be efficiently delivered to *N. benthamiana* cells by Agroinfiltration. *Agrobacterium* cultures with plasmids pJL 128 was mixed with *Agrobacterium* cultures containing plasmid pJL 122. *Agrobacterium* mixtures were then infiltrated into *N. benthamiana* cells. Several days post infiltration DNA was extracted from infiltrated leaves and analyzed by the procedure outlined in Example 1. Results of one such experiment are presented in (FIG. 4B). Multiple indel mutations were identified indicating that TMV can express a functional Cas9 protein in plant cells.

Notes on TMV Vectors:

The TMV genome is a ss RNA molecule that is capable of self-replication in plants. To modify TMV into an expression vector, cDNA clones of the TMV genome are modified using standard molecular techniques. Foreign sequences can be inserted downstream of an RNA sequence that functions as a viral subgenomic RNA promoter. Once TMV vector cDNA clones are constructed, they must be converted into an RNA molecule in order to be biologically active. This can be done in planta, by delivering the vector cDNA under the control of a plant functional promoter, such as the CaMV 35S promoter. For example, this is how TMV RNAs can be delivered via Agroinfection. Alternatively, TMV-derived cDNAs under the control of the T7 RNA polymerase promoter can be transcribed in vitro. The resulting RNAs are biologically active and capable of self-replication and gene expression once introduced into plant cells. For more detailed explanation on TMV vectors see the Review by (Pogue et al. "Tobamovirus Transient Expression Vectors: Tools for Plant Biology and High-Level Expression of Foreign Proteins in Plants. Plant Molecular Biology Manual. L4: 1-27. Kluwer Academic Publishers" (1998)).

Summary of Results of Example 2

The results obtained surprisingly indicated that TMV vectors can express a functional Cas9 protein, contrary to the widely held-belief that viral vectors were incapable of expressing such large cargo genes. This second surprising finding suggested that the viral capsid could expand to accommodate larger cargo.

Example 3: Expression of a Functional Guide RNA from a TMV Vector

As discussed in earlier sections of this document, it was unknown whether viral vectors could be used to express functional guide RNAs for CRISPR gene editing. Viral vectors cap their transcripts, and further generate transcripts with extra 5' and 3' sequences beyond the coded transcriptional start and end locations. These structures were believed to have the strong potential for disrupting guide RNA function.

To determine if TMV vectors could indeed produce functional sgRNAs we constructed the TMV based expression vector pJL 155 (FIG. 5A—SEQ ID No. 83). *N. benthamiana* leaves were agroinfiltrated with a mixture of Agro cultures harboring either plasmids pJL 155 or pJL 156 (156 not shown) along with Agro cultures containing plasmid pJL 125 (for transient expression of Cas9 protein). *N. benthamiana* genomic DNA was extracted several days later and analyzed according the workflow in Example 1. The results obtained (FIG. 5B) indicate that indeed TMV vectors can express functional sgRNAs in plant cells.

Figures 5A, 5B:
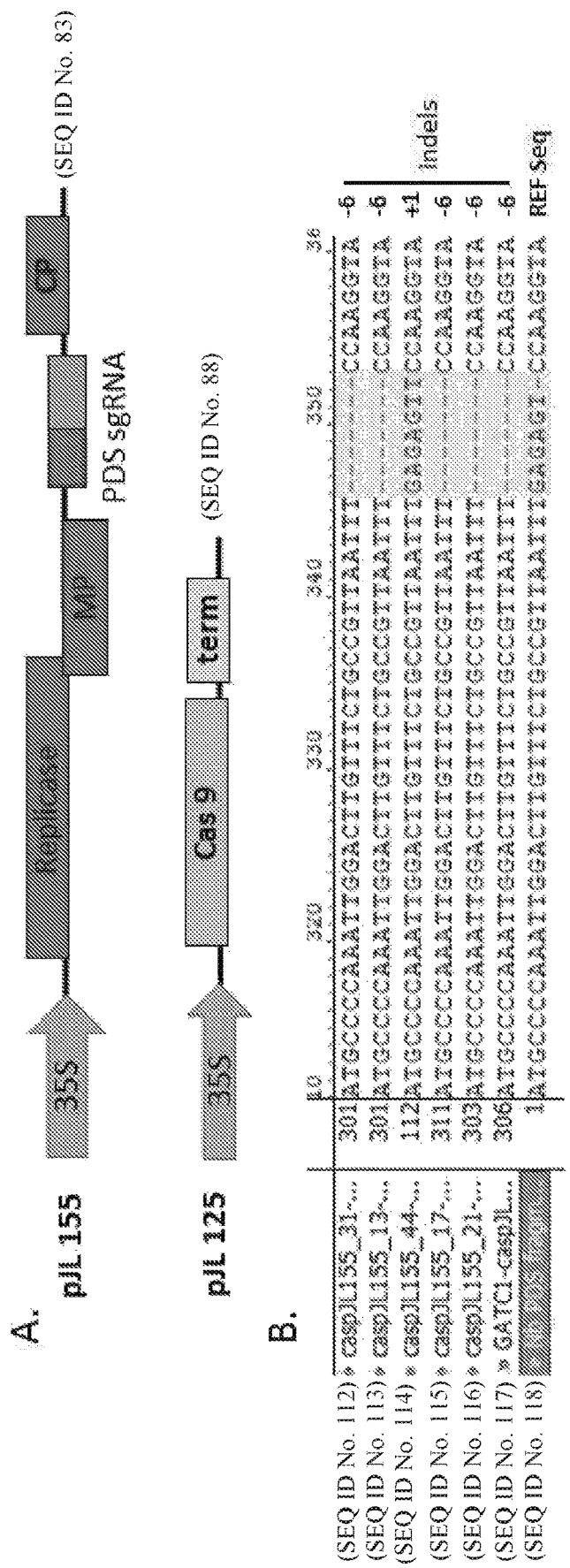
FIG. 5A to FIG. 5B—Illustration of first generation vectors expressing recombinant self-replicating RNA of the present disclosure.

As shown in FIG. 5B, the bottom sequence contains the DNA sequence of the 'wild type' locus in N. benthamiana. The central highlighted region identifies the region where insertions or deletions were identified by DNA sequencing analysis. For example five different cloned PCR products were found to have a 6 nucleotide deletion, whereas one clone (caspJL155_44) had a single "T" insertion.

A single nucleotide insertion as well as 7 nucleotide deletion at the plant genome site targeted by the RGEN were found. This indicates that a gRNA with a 5' cap, and at least 62 nucleotides of 'extra' sequence on the 5' end and 1208 nucleotides on the 3' end is still functional as a guide RNA for the Cas9 nuclease.

A comparison of the guide RNA sequences produced by a standard U6 plant promoter from pJL 122 and the predicted guide RNAs produced by the self-replicating RNAs is presented in Table 1. Note the additional sequences on the 5' and 3' ends of the sgRNA Table 2.

TABLE 1

Comparison of guide RNA synthesis among standard Pol III promoters and expression by recombinant self-replicating RNAs of the present disclosure.

| Construct Name | gRNA from: | 5' cap | gRNA length | 'extra 5' nt | 'extra 3' nt | comments |
|---|---|---|---|---|---|---|
| pJL 122 | Pot III promoter | No | 103 nts | 0 | 0 | Agroinfiltration transient expression vector |
| pJL 155 | MN subgenomic promoter | Yes | 1366 nts | 62 | 1208 | TMV vector express CP |

TABLE 2

Comparison of guide RNA synthesis among standard Pol III promoters and expression by recombinant self-replicating RNAs of the present disclosure.

| Guide RNA Source | Sequence |
|---|---|
| pJL 122 (Guide RNA sequence bolded) | GCCGTTAATTTGAGAGTCCAGTTTTAGAGCTAGAAATAG CAAGTTAAAATAAGGCTAGTCCGTTATCAACTTGAAAAA GTGGCACCGAGTCGGTGCTTTTTTT (SEQ ID No. 70) |
| TMV vector cloned in pJL 155 (Guide RNA sequence bolded. Coat protein underlined.) | GTTTTAAATAGATCTTACAGTATCACTACTCCATCTCAG TTCGTGTTCTTGTCAttaaTtaaGCCGTTAATTTGAGAG TCCAGTTTTAGAGCTAGAAATAGCAAGTTAAAATAAGGC TAGTCCGTTATCAACTTGAAAAAGTGGCACCGAGTCGGT GCctaggGCGGCCGCtcgag**GGGTAGTCAAGATGCATAA TAAATAACGGATTGTGTCCGTAATCACACGTGGTGCGTA CGATAACGCATAGTGTTTTTCCCTCCACTTAAATCGAAG GGTTGTGTCTTGGATCGCGCGGGTCAAATGTATATGGTT CATATACATCCGCAGGCACGTAATAAAGCGAGGGGTTCG GGTCGAGGTCGGCTGTGAAACTCGAAAAGGTTCCGGAAA ACAAAAAAGAGAGTGGTAGGTAATAGTGTTAATAATAAG AAAATAAATAATAGTGGTAAGAAAGGTTTGAAAGTTGAG GAAATTGAGGATAATGTAAGTGATGACGAGTCTATCGCG TCATCGAGTACGTTTTAATCAATATGCCTTATACAATCA ACTCTCCGAGCCAATTTGTTTACTTAAGTTCCGCTTATG CAGATCCTGTGCAGCTGATCAATCTGTGTACAAATGCAT TGGGTAACCAGTTTCAAACGCAACAAGCTAGGACAACAG TCCAACAGCAATTTGCGGATGCCTGGAAACCTGTGCCTA GTATGACAGTGAGATTTCCTGCATCGGATTTCTATGTGT ATAGATATAATTCGACGCTTGATCCGTTGATCACGGCGT TATTAAATAGCTTCGATACTAGAAATAGAATAATAGAGG TTGATAATCAACCCGCACCGAATACTACTGAAATCGTTA ACGCGACTCAGAGGGTAGACGATGCGACTGTAGCTATAA GGGCTTCAATCAATAATTTGGCTAATGAACTGGTTCGTG |

TABLE 2-continued

Comparison of guide RNA synthesis among standard Pol III promoters and expression by recombinant self-replicating RNAs of the present disclosure.

| Guide RNA Source | Sequence |
|---|---|
| | GAACTGGCATGTTCAATCAAGCAAGCTTTGAGACTGCTA GTGGACTTGTCTGGACCACAACTCCGGCTACTTAGCTAT TGTTGTGAGATTTCCTAAAATAAAGTCACTGAAGACTTA AAATTCAGGGTGGCTGATACCAAAATCAGCAGTGGTTGT TCGTCCACTTAAATATAACGATTGTCATATCTGGATCCA ACAGTTAAACCATGTGATGGTGTATACTGTGGTATGGCG TAAAACAACGGAAAAGTCGCTGAAGACTTAAAATTCAGG GTGGCTGATACCAAAATCAGCAGTGGTTGTTCGTCCACT TAAAAATAACGATTGTCATATCTGGATCCAACAGTTAAA CCATGTGATGGTGTATACTGTGGTATGGCGTAAACAACG GAGAGGTTCGAATCCTCCCCTAACCGCGGGTAGCGGCCC A (SEQ ID No. 90) |

Summary of Results of Example 3

Recombinant self-replicating RNAs, with or without the coat protein gene, can express functional sgRNAs in plant cells. These RNA-produced sgRNAs are functional even though they have extensive "extra" RNA sequences on both the 5' and 3' ends of the functional sgRNA. This indicates that the 'extra' sequences do not disrupt folding of the sgRNA so much that it is no longer recognized by Cas9 protein.

Figures 6A, 6B, 6C:
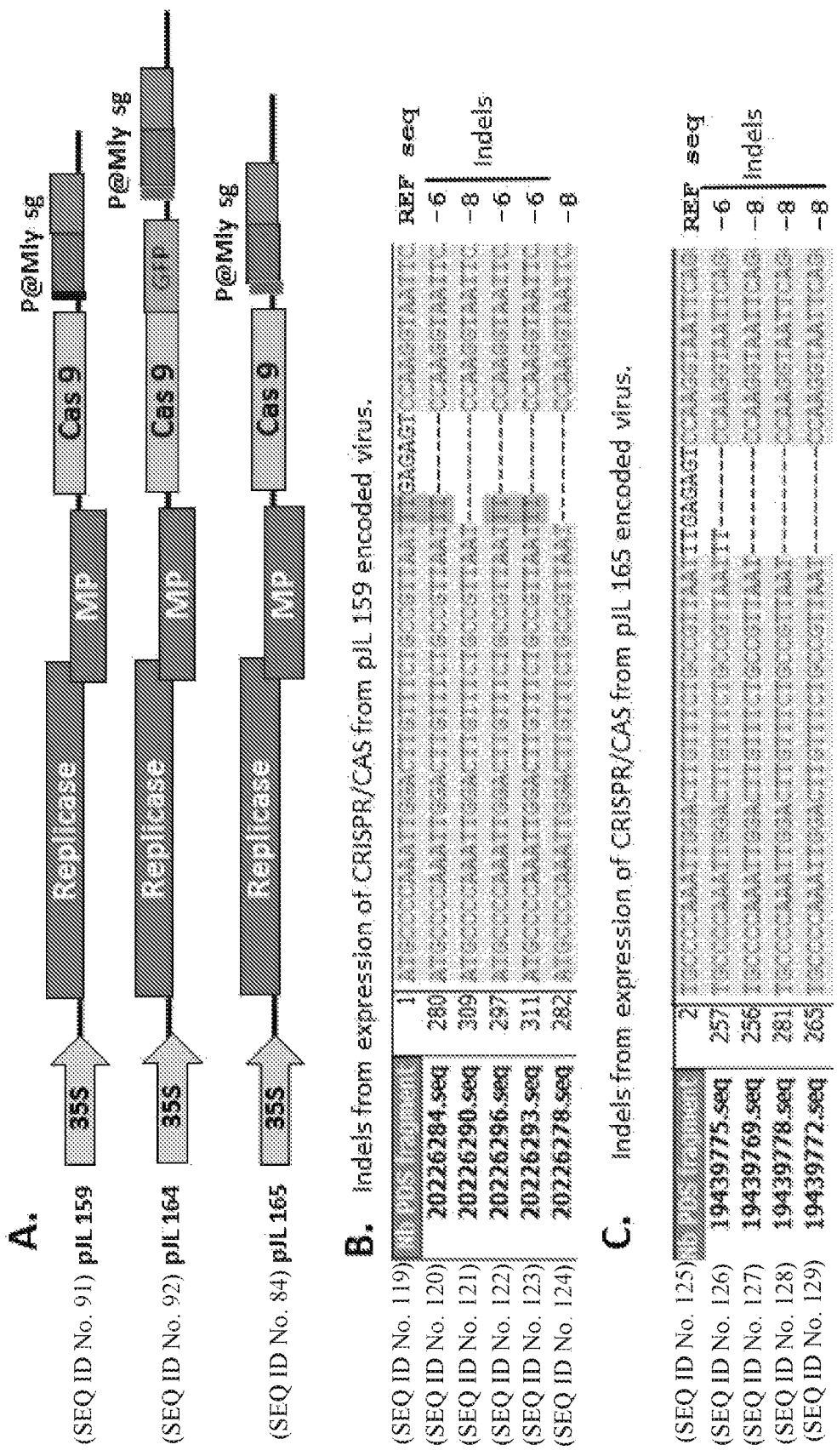
FIG. 6A to FIG. 6C—Illustration of first generation vectors expressing both the CRISPR Cas9 endonuclease and the guide RNA.

Example 4: Expression of Both a Functional Cas9 Protein and sgRNA from a Single TMV Based Viral Vector In order to determine if a recombinant self-replicating RNA could express both a functional Cas9 protein and sgRNA, we modified our existing vectors (constructed for Examples 1-3) to generate plasmids pJL 159 (SEQ ID No. 91), 164 (SEQ ID No. 92—results not shown) and pJL 165 (SEQ ID No. 84). Maps of the T-DNA portions of these plasmids (containing the TMV vector cDNA sequences) are shown in FIG. 6A. Because of the biology of recombinant self-replicating RNA vectors discussed in earlier portions of this application and in Example 3, the sgRNAs produced from pJL-159, -164, or -165 are not exactly like the 'prototype' sgRNA produced from the transient expression of the standard Pol III vector pJL 122. Guide RNA transcripts produced by each of these vectors was isolated and sequenced. The differences between the sgRNAs produced from pJL 122, and the recombinant self-replicating RNAs cloned in pJL-159 and -165 are presented in Table 3. Note the additional sequences on the 5' and 3' ends of the sgRNA Table 4.

TABLE 3

Comparison of guide RNA synthesis among standard Pol III promoters and expression by recombinant self-replicating RNAs of the present disclosure.

| Construct Name | gRNA from: | 5' cap | gRNA length | 'extra 5' nt | 'extra 3' at | comments |
|---|---|---|---|---|---|---|
| pJL 122 | Pol III promoter | No | 103 nts | 0 | 0 | Agroinfiltration transient expression vector |

TABLE 3-continued

Comparison of guide RNA synthesis among standard
Pol III promoters and expression by recombinant
self-replicating RNAs of the present disclosure.

| Construct Name | gRNA from: | 5' cap | gRNA length | 'extra' 5' nt | 'extra' 3' at | comments |
|---|---|---|---|---|---|---|
| pJL 165 | TMV subgenomic promoter | Yes | 400 nts | 62 | 241 | TMV vector also expresses Cas9, but no virus CP. |
| pJL 159 | Synthetic TMV subgenomic promoter | Yes | 321 | 3 | 223 | TMV vector also expresses Cas9, but no virus CP. |

TABLE 4

Comparison of guide RNA synthesis among standard
Pol III promoters and expression by recombinant
self-replicating RNAs of the present disclosure.

| Guide RNA Source | Sequence |
|---|---|
| pJL 122 (Guide RNA sequence bolded) | GCCGTTAATTTGAGAGTCCAGTTTTAGAGCTAGAAATAG CAAGTTAAAATAAGGCTAGTCCGTTATCAACTTGAAAAA GTGGCACCGAGTCGGTGCTTTTTTT (SEQ ID No. 70) |
| pJL 165 (Guide RNA sequence bolded) | GTTTTAAATAGATCTTACAGTATCACTACTCCATCTCAG TTCGTGTTCTTGTCAttaattaaGCCGTTAATTTGAGAG TCCAGTTTTAGAGCTAGAAATAGCAAGTTAAAATAAGGC TAGTCCGTTATCAACTTGAAAAAGTGGCACCGAGTCGGT GCctagggcggccgcggcggccgcGGTCCTGCAACTTGA ggtagtcaagatgcataataaataacggattgtgtccgt aatcacacgtggtgcgtacgataacgcatagtgtttttc cctccacttaaatcgaagggttgtgtcttggatcgcgcg ggtcaaatgtatatggttcatatacatccgcaggcacgt aataaagcgaggggttcgaatcccccgttacccccggt agggccca (SEQ ID No. 93) |
| pJL 159 (Guide RNA sequence bolded) | GTTGCCGTTAATTTGAGAGTCCAGTTTTAGAGCTAGAAA TAGCAAGTTAAAATAAGGCTAGTCCGTTATCAACTTGAA AAAGTGGCACCGAGTCGGTGCCgcGGTCCTGCAACTTGA ggtagtcaagatgcataataaataacggattgtgtccgt aatcacacgtggtgcgtacgataacgcatagtgtttttc cctccacttaaatcgaagggttgtgtcttggatcgcgcg ggtcaaatgtatatggttcatatacatccgcaggcacgt aataaagcgaggggttcgaatcccccgttacccccggt agggccca (SEQ ID No. 94) |

U1 CP subgenomic RNA promoter has been well characterized by deletion and site directed mutagenesis, and the transcription start site has been determined (see Grdzelishvili et al. "Mapping of the Tobacco Mosaic Virus Movement Protein and Coat Protein Subgenomic RNA Promoters in Vivo." *Virology* (2000): 275, 177-192). The active promoter extends into the transcribed sequence and CP coding sequence. Without wishing to be bound by any one theory, we hypothesized that the U1 CP subgenomic RNA promoter is a stem loop RNA structure. We also hypothesized that the critical nucleotides for recognition of this RNA fold as a promoter are in the 'top' of the stem loop. These are sequences upstream of the transcription start site that make a hairpin fold, with a couple of "loop-out" regions. To make the sgRNA have as few "non-guide RNA" nts as possible, and based on this hypothesis, we generated a sequence that may fold like the U1 CP promoter and contain the PDS-Mly: guide RNA sequence after the CP mRNA transcription start site. This synthetic sequence is called JAL 537_V3. The 5' and 3' ends of this gene block contain sequences that overlap with the sequences in pJL 129 upstream and downstream of the Nod site. JAL 537_V3 gene block can be inserted into vectors of the present invention. The structure of U1 CP subgenomic RNA promoter and JAL 537_V3 are shown in FIG. 11. The resulting synthetic DNA was inserted into NotI cut pJL 129 plasmid using New England Biolabs Hi Fi assembly method. The resulting plasmid was named pJL 159. The sgRNA expected to be produced from pJL 159 contains only about 3 'extra' nts on the 5' end of the sRNA (SEQ ID NO. 94).

In some embodiments, the subgenomic promoter of the present disclosure comprises a transcription start site. In some embodiments, the genome sense sequence of the subgenomic RNA will start with a G nt that is flanked by about 9 bp on either side. Thus, in some embodiments, the present invention teaches a transcriptional start site according to the following sequence: ATCGGATTCGTTT-TAAATA (SEQ ID NO. 146). In some embodiments, the minimally active subgenomic promoter is about 80 nts, spanning about 69 nts upstream and 12 nts downstream of the transcription start site (see e.g., SEQ ID NO. 147). In some embodiments, the fully active spans about 157 nts upstream and 54 nts downstream of the transcription start site (see e.g., SEQ ID NO. 148).

To test activity of these vectors, plasmid pJL 159, 164 or 165 were first individually transformed into *Agrobacterium*. Then Agro cultures with these plasmids were infiltrated into *N. benthamiana* leaves, and processed according to the experimental workflow outlined Example 1. Results of the experiment are presented in (FIG. 6B and FIG. 6C).

Results indicate that indel mutations were created at the MlyI site targeted by the viral produced CRISPR/CAS9 system. The diversity of indel mutations recovered was less than when the Cas9 protein and sgRNA are expressed from transient expression vectors pJL 125 and pJL 122, respectively.

As shown in FIG. 6C, the top sequence titled "Nb PDS fragment" is the sequence of the wild type gene. The remaining rows in the figure are DNA sequence data from individual cloned PCR products. The '775.seq' (second line from top) is missing 6 nucleotides (GAGAGT—SEQ ID No. 95). The remaining 4 isolates all show a deletion of 8 nucleotides (TTGAGAGT—SEQ ID No. 95).

In this particular example targeted indels of 6 or 8 nucleotides were identified. This demonstrates that a single recombinant self-replicating RNA can express both, a functional Cas9 nuclease and guide RNA. To inventor's knowledge, this has not previously been demonstrated for a plant viral vector.

The recombinant self-replicating RNA encoded in pJL 159 has some significant differences from the vector in pJL 165. Like the '165 vector, the '159 vector expresses both the Cas9 nuclease and the guide RNA. However, unlike the '165 vector the viral subgenomic promoter that controlled the expression of the guide RNA was from a synthetic promoter. This synthetic promoter was designed to produce a guide RNA with fewer 'non-guide' RNA nucleotides on its 5' end than the guide RNA expressed from the '165 vector. The 159 vector does not express a coat protein.

The lack of expression of a CP by the 159 virus will prevent this vector from moving systemically in plants and also will not generate virus particles in infected cells. As a result, this vector will not be transmitted from plant to plant without purposeful effort. This feature may be useful from a biocontainment standpoint.

As shown in FIG. 6B, the top sequence is the nucleotide sequence of the 'wild type' sequence targeted by the nuclease expressed from the recombinant self-replicating RNA in the 159 vector. The nucleotide sequence of seven independent clones are also presented. The '284-, 296-, and 293-.seq' entries are all missing 6 nucleotides (GAGAGT—SEQ ID No. 97). The remaining two isolates all show a deletion of 8 nucleotides (TTGAGAGT—SEQ ID No. 98). Curiously, both 6 and 8 nucleotide deletions were also found with the pJL-165 vector expressing Cas9 protein and guide RNA.

This data also suggests that the recombinant self-replicating RNA in the pJL 159 vector design is also capable of expressing a functional Cas9 site directed nuclease system in plant cells by expressing both Cas9 protein and a guide RNA.

Summary of Results of Example 4

Results indicate that a functional CRISPR CAS system can be expressed from a single recombinant self-replicating RNA. This has never before been reported.

Example 5: Direct RNA Delivery of CRISPR Complexes

Previously examples reported successful delivery of a functional CRISPR/Cas9 site directed nuclease via a plant virus that is synthesized in the host cell by a DNA expression vector. This example will demonstrate the direct delivery of pre-synthesized recombinant self-replicating RNAs into plant cells. TMV vectors used in above examples were delivered into plants via Agroinfection. That is to say as T-DNAs via *Agrobacterium*. Transcription of the T-DNAs in planta resulted in the production of TMV based RNAs which could undergo initiate self-replication and gene expression. In the present example, the goal is to generate a CRISPR/CAS system that does not rely on *Agrobacterium* or T-DNA integration. This method may have some regulatory advantages, in addition to providing a vector system that will enable delivering a gene editing system to explants or embryos.

The vector cDNA in pJL 186 plasmid can be transcribed in vitro with T7 RNA polymerase and the resulting RNAs, when delivered to plant cells, will initiate self-replication and expression of both a SpCas9 protein and a single guide RNA (sgRNA). The viral-produced SpCas9 protein and sgRNA are functional, and can target and cleave specific plant sequences in the nucleus. To date we have used this system to generate indel mutations at a targeted locus in the *N. benthamiana* genome.

Figure 7:
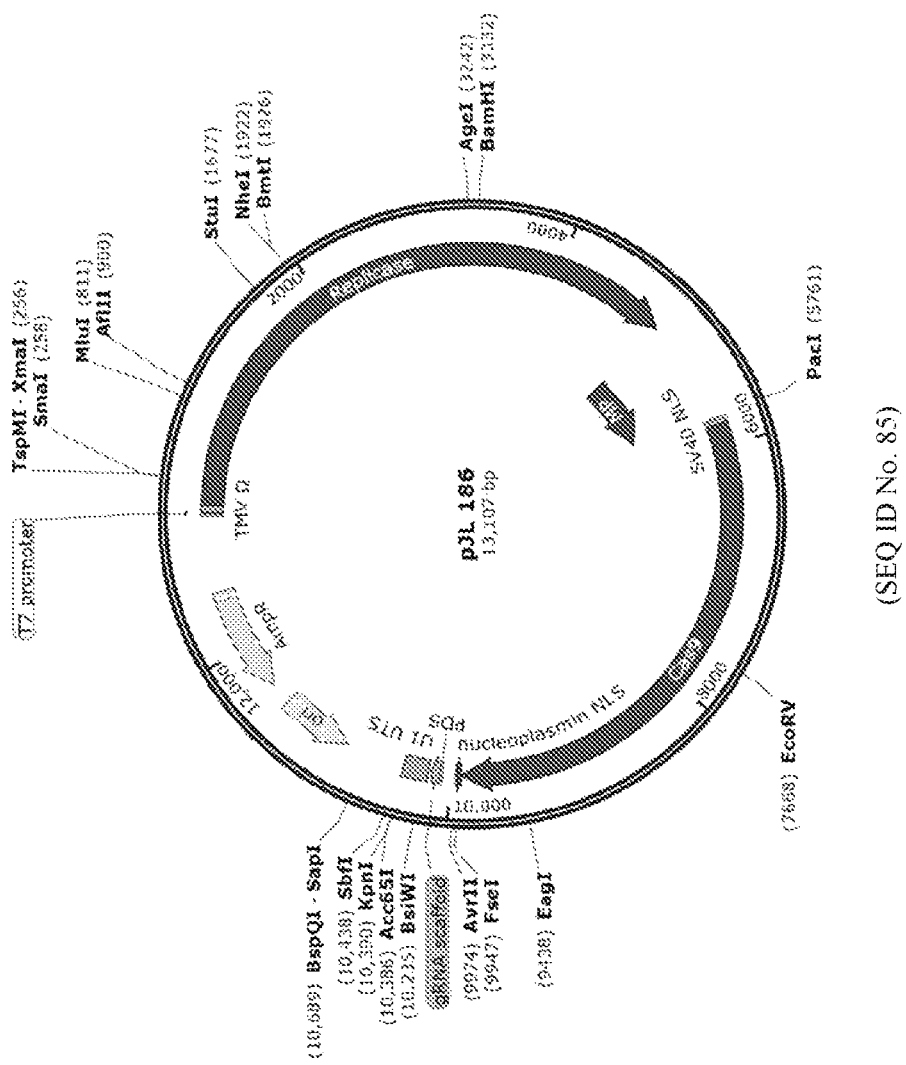
FIG. 7—Vector map of pJL 186 second generation vector, expressing the recombinant self-replicating RNA encoding the CRISPR Cas9 endonuclease and the guide RNA. Functional self-replicating RNA can be produced by in vitro transcription via a T7 promoter, and can then be delivered to plant cells in the absence of any recombinant DNA sequences, if desired. The plasmid p30B (Shivprasad et al 1999. Virology 255, 312-323), which contains a TMV cDNA under the control of a T7 promoter, in a high copy pUC plasmid backbone, was digested with AgeI and KpnI restriction enzymes, and the backbone fragment was isolated. The 7.1 Kb AgeI-KpnI fragment of pJL 159 was then ligated to the vector backbone fragment. The resulting plasmid was called pJL 186.

Here we report on a second version of this viral vector. The plasmid pJL 187, like pJL 186, contains a TMV-based expression vector designed to express Cas9 protein and sgRNA in plant cells. The two vectors differ, however in the subgenomic promoter used to express the guide RNA sequence expressed in planta. A vector map of pJL 186 is provided in (FIG. 7). A Vector map of pJL 187 is provided in (FIG. 8).

The differences between the expected sgRNAs produced from pJL 122, and the recombinant self-replicating RNAs cloned in pJL-186 and -187 are presented in Table 5.

TABLE 5

Comparison of guide RNA synthesis among standard Pol III promoters and expression by recombinant self-replicating RNAs of the present disclosure.

| Construct Name | gRNA from: | 5' cap predicted | gRNA length | 'extra 5' nt | 'extra 3' nt | comments |
| --- | --- | --- | --- | --- | --- | --- |
| pJL 122 | Pol III promoter | No | 103 nts | 0 | 0 | Agro-infiltration transient expression vector |
| pJL 186 | Synthetic TMV sub-genomic promoter | Yes | ~346 nts | 3 | ~240 | TMV vector also expresses Cas9, but no virus CP. |
| pJL 187 | TMV sub-genomic promoter | yes | ~405 nts | 62 | ~240 | TMV vector also expresses Cas9, but no virus CP. |

Figure 9:
FIG. 9—Depicts a sequence alignment of indel mutations recovered from plant cells infected with the recombinant self-replicating RNA produced by T7 in vitro transcription reactions of the pJL 186 vector and the pJL 187 vector.

To test the functionality of the plant virus based expression vector contained in pJL 186 and pJL 187, the plasmids were transcribed by T7 RNA polymerase in vitro. The resulting RNAs were transfected into *N. benthamiana* protoplasts using Polyethylene Glycol (PEG)-mediated transfection. Several days post transfection, DNA was extracted from protoplasts. Resulting DNA was used in a PCR reaction with primers designed to amplify up the region of the *N. benthamiana* genome targeted by the CRISPR/Cas9 system produced by the pJL 186 or pJL 187-derived vector. The resulting PCR products were sequenced to characterize indel mutations resulting from the activity of the vector produced site directed nuclease. Results from these experiments are shown in (FIG. 9).

These results show that the recombinant self-replicating RNAs of the present disclosure can successfully produce a functional CRISPR/Cas9 site directed nuclease system for plant gene editing. The vectors in pJL 186 and pJL 187 are two such examples, and both have now been demonstrated to be functional. Furthermore the viral based vector can be delivered to cells as a single RNA molecule. No 'recombinant DNA' is introduced into cells. There are multiple ways of delivering these RNAs to plant cells including physical abrasion in the presence of the RNA, use of chemicals or electrical pulses to enable transfer of RNA across the plant cell, or even biolistic delivery.

Example 6: Construct a CRISPR/CAS System that Efficiently Creates Indel Mutations in the Tomato VPE5 Gene Hypothesis:
Indel mutations in the tomato VPE5 gene can lead to higher brix levels in tomato fruit.

To test this hypothesis we will create indel mutations in the tomato VPE5 gene using a CRISPR/CAS nuclease system according to methods disclosed in this application. We have already designed sgRNAs for targeting CAS9 nuclease to three different regions of the VPE5 coding sequence. Our first experiments will be to test the relative efficiency of the 3 different VPE5-targetting sgRNAs.

Plasmid vectors for in vivo expression of three different sgRNAs (targeting VPE5 coding sequence at different locations) will be constructed. These sgRNAs along with CAS9 protein will be transiently expressed in tomato protoplasts. Several days later, DNA will be extracted from protoplasts.

DNA will be assayed for indel mutations in targeted regions of the VPE5 gene, using a workflow very similar to that outlined in Example 1. The most efficient sgRNA will be selected for use in Examples 7 and 8.

Example 7: Construct a TMV Vector that Expresses a CRISPR/CAS that can Generate Indel Mutations in Tomato VPE5 Gene To accomplish this objective a TMV vector will be constructed with the following features: (1) can be transcribed by T7 RNA polymerase in vitro, (2) expresses a CRISPR/CAS system that cuts the tomato DNA in the VPE5 gene open reading frame. In vitro produced RNA will be used to infect tomato protoplasts. Protoplasts will be analyzed for indel mutations in VPE5 gene to demonstrate functionality of vector.

Example 8: Generate Tomato Plants with Knock Out Mutations in VPE5 Gene

Tobacco mosaic virus has a broad host range. TMV can replicate in a wide range of plant species. Therefore we expect that any vector based on TMV is also functional in a wide range of plant species.

To demonstrate this, we constructed a TMV-based vector system designed to express both the Cas9 protein and a single guide RNA (sgRNA) which would guide the Cas9 protein to an endogenous tomato gene (i.e., VPE5 locus). Transcripts of this vector were then transfected into tomato protoplasts using conditions similar to that used for transfection of *N. benthamiana* protoplasts. Several days post transfection the DNA from a portion of the transfected tomato protoplasts was extracted. The resulting DNA was used as template in a PCR reaction using primers that flanked the portion of the VPE5 locus targeted by the virus-expressed CRISPR/Cas system. Cleavage of the VPE5 target by CRISPR/Cas was expected to create indel mutations in the VPE5 locus. Indels was measured by T7E1 assay (New England Biolabs) according to manufacturer's instructions. Details of the experiment are presented below.

Figure 13:
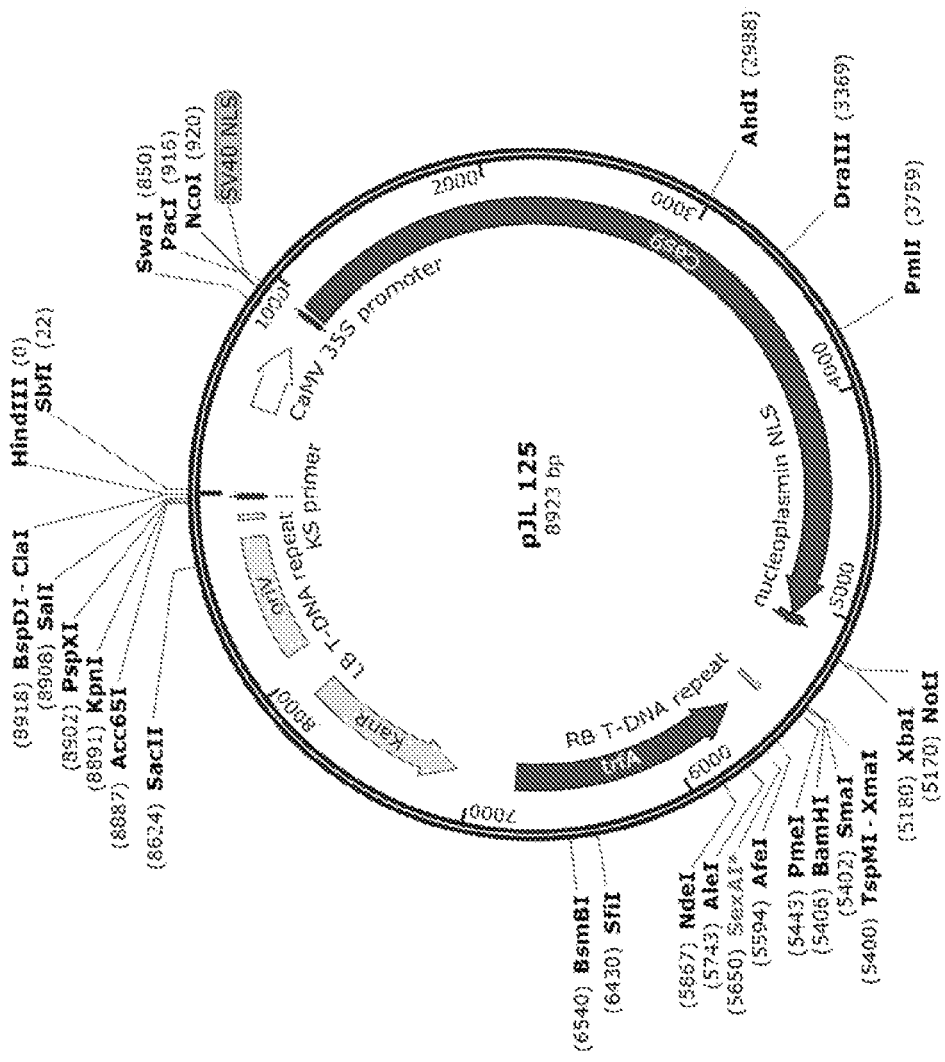
FIG. 13—Vector map of pJL 125, expressing a polynucleotide encoding the CRISPR Cas9 endonuclease. 35S=CAMV 35S Promoter: Cas9=Cas9 ORF.
Figure 14:
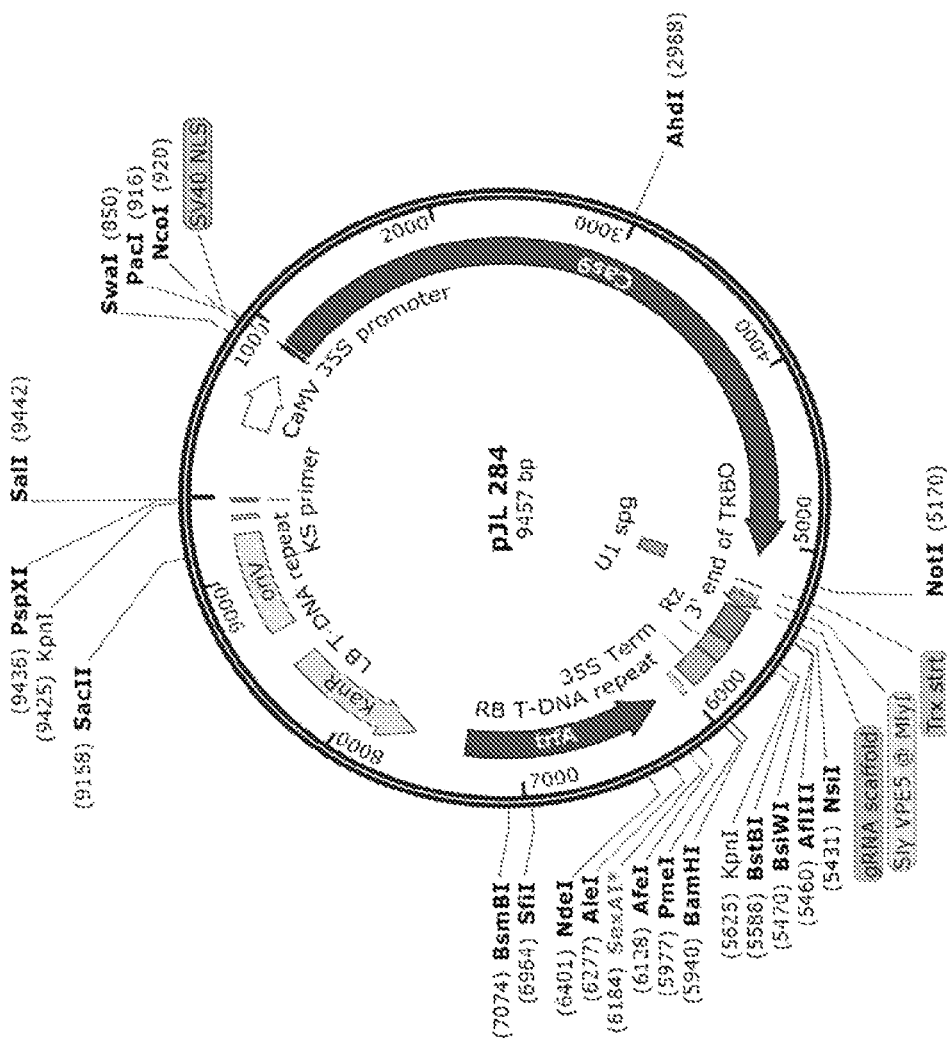
FIG. 14—Vector map of pJL 284, which was constructed by inserting a PCR product into vector pJL 125. The vector contains CAMV 35S Promoter, Cas9 coding sequence, a TMV subgenomic RNA promoter, transcription start site for TMV subgenomic RNA synthesis as a leader sequence, a spacer sequence of the tomato VPE5 gene, TRBO 3' UTS-Ribozyme, 35S terminator, and Right Border.

Step 1: Construction of a TMV Based Vector for Gene Editing of a Tomato Gene.

pJL 285 was the plasmid vector used for creating in vitro transcripts encoding for a TMV-based RNA vector that could direct Gene editing in tomato. This plasmid was created in a step-wise process through construction of the intermediate vector pJL 284.

pJL 284 intermediate cloning vector was constructed by using plasmid pJL 125 as a backbone. Vector maps for pJL 125 and pJL 284 are demonstrated in FIG. 13 and FIG. 14, respectively.

The DNA sequence to be inserted into pJL 125 backbone was constructed by PCR. A portion of plasmid pJL 165 was amplified with primers JAL 563 (SEQ ID NO. 163) and JAL 778 (SEQ ID NO. 166) to produce an amplified 168 bp sequence (SEQ ID NO. 159). This amplified sequence contain sequences encoding for part of the TMV subgenomic RNA promoter, transcription start site for TMV subgenomic RNA synthesis as a leader sequence and, a spacer sequence of the tomato VPE5 gene (SEQ ID NO. 160) at its very 3' end.

Figure 15:
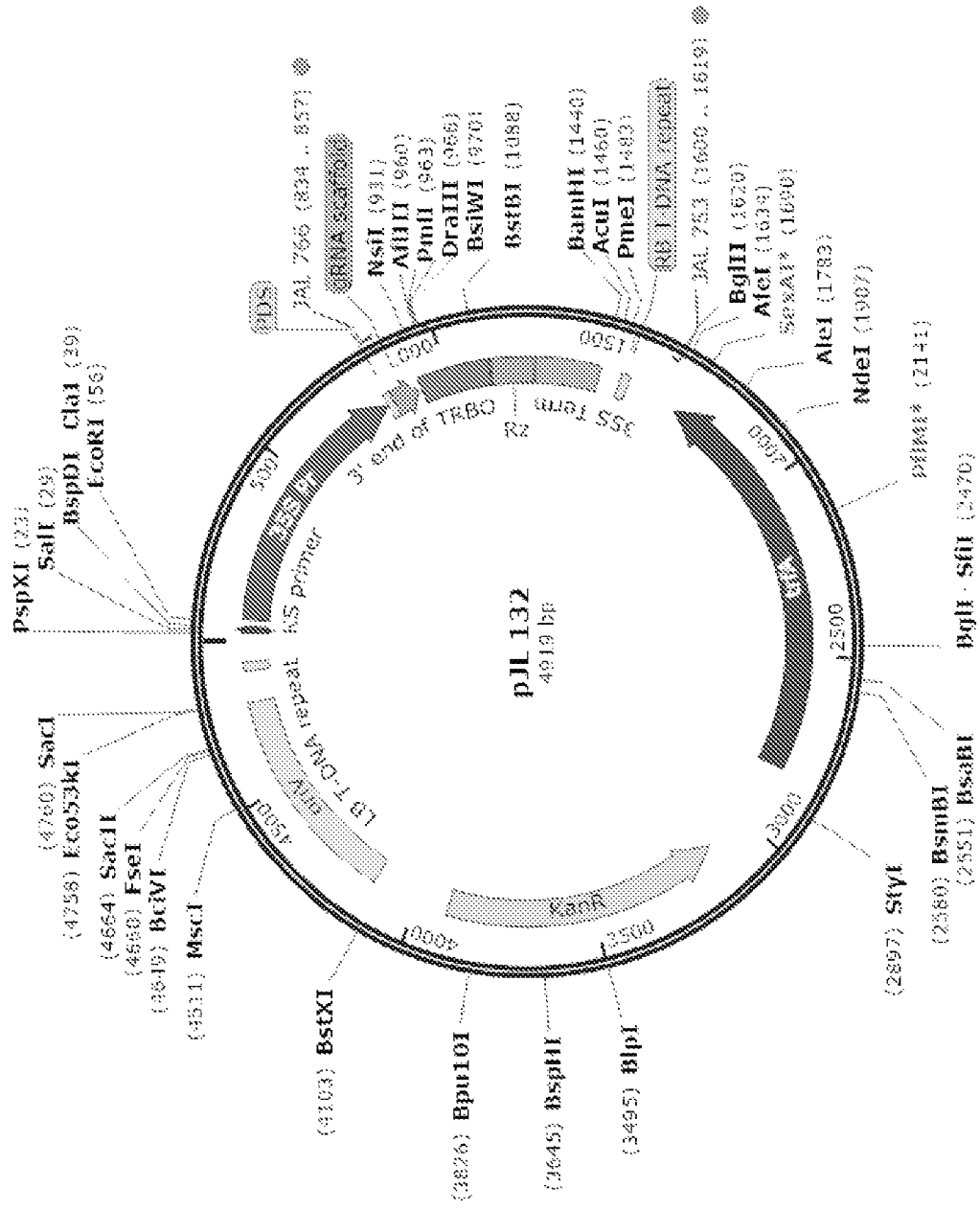
FIG. 15—Vector map of pJL 132, which was used as a template to amplify the following functional sequences: sgRNA (with spacer for tomato VPE5 gene)-TRBO 3' UTS-Ribozyme-35S terminator-Right Border (SEQ ID NO. 161).

This PCR product was joined by Sequence Overlap Extension (SOE) PCR to the PCR product of primers JAL 753 (SEQ ID NO. 164) and JAL 766 (SEQ ID NO. 165) of template pJL 132 (FIG. 15). The PCR product of primers JAL 753 and JAL 766 using template pJL 132 encodes following functional sequences: sgRNA (with spacer for tomato VPE5 gene at the 5' end)-TRBO 3' UTS (untranslated sequence)-Ribozyme-35S terminator-Right Border T-DNA repeat (SEQ ID NO. 161). After joining of these two PCR products by SOE PCR, the final constructed synthetic DNA sequence was produced (SEQ ID NO. 162).

The synthetic DNA sequence was digested with restriction endonucleases AvrII and BamHI to generate a product which was ligated into pJL 125 degisted with restriction endonucleases BamHI and XbaI to create the plasmid pJL 284. This ligation placed the TMV U1 subgenomic promoter, sgRNA consisting of a spacer sequence for tomato VPE5 locus, and the 3' end of the TRBO vector downstream of the Cas9 coding sequence in pJL 125 vector backbone.

Figure 16:
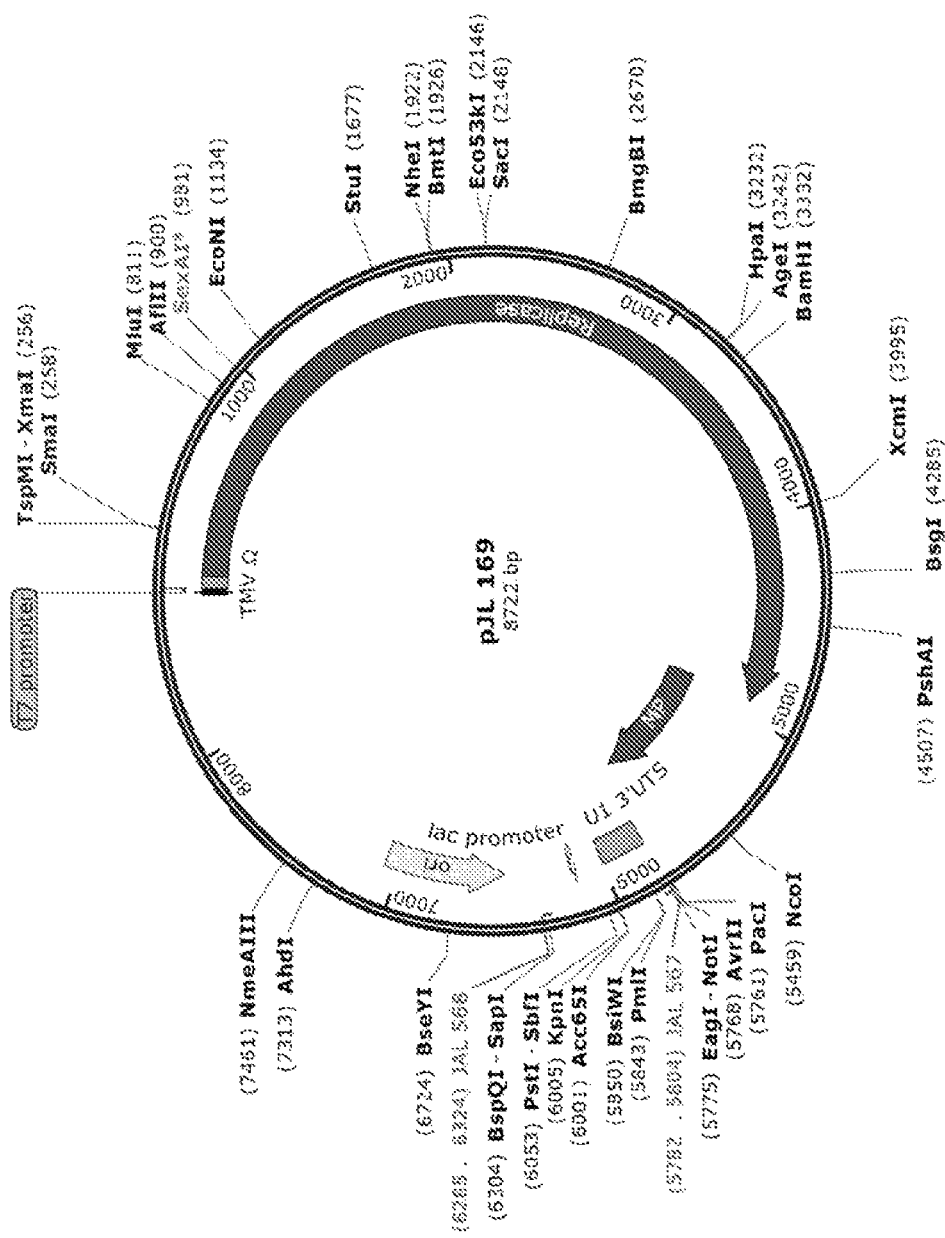
FIG. 16—Vector map of pJL 169, which was used as a backbone vector to construct vector pJL 285. The vector contains sequence encoding replicase and Movement Protein (MP).
Figure 17:
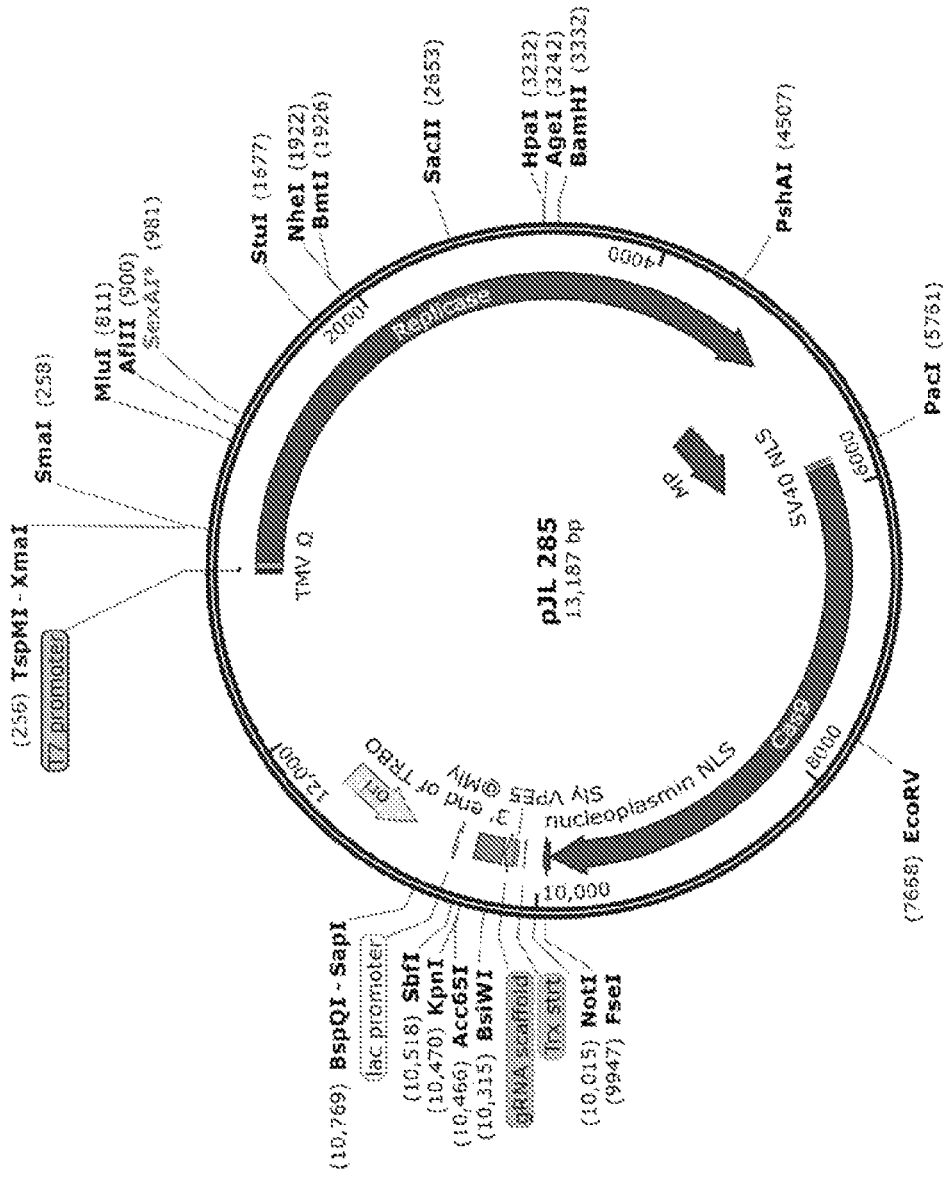
FIG. 17—Vector map of pJL 285, which was used to produce self-replicable RNA for transfecting tomato plants.

Vector pJL 284 was digested with restriction endonucleases PacI and KpnI to isolate a fragment of 4.7 kb. A backbone vector pJL 169 (FIG. 16) was also disgested with PacI and KpnI to isolate a fragment of 8.4 kb. The two fragments were ligated to produce the resulting plasmid pJL 285 (FIG. 17). The resulting plasmid pJL 285 contains a cDNA copy of a TMV vector which can direct the expression of an mRNA for the Cas9 protein as well as a sgRNA for the tomato VPE5 locus.

Step 2: Infecting Tomato Cells with the TMV Based Gene Editing Vector Encoded by pJL 285

Transcription of pJL 285 in vitro with T7 RNA polymerase (Ambion mMessage Machine kit) resulted in the TMV based vector RNA. The resulting RNA was transfected into tomato protoplasts using PEG and methods similar to *N. benthamiana* transfection described earlier.

Several days after transfection (e.g., 2-3 days), DNA was extracted from the protoplasts. The targeted VPE5 locus was amplified with F (SEQ ID NO. 169) and R primers (SEQ ID NO. 170). The resulting ~380 bp product was cleaned up and analyzed for indels using the T7E1 assay (New England Biolabs) according to manufacturer's instructions. The resulting products were run on an agarose gel and stained. If Indels were created a band of about 320 bp was expected in PCR product from protoplasts transfected with transcripts from pJL 285.

Figure 18:
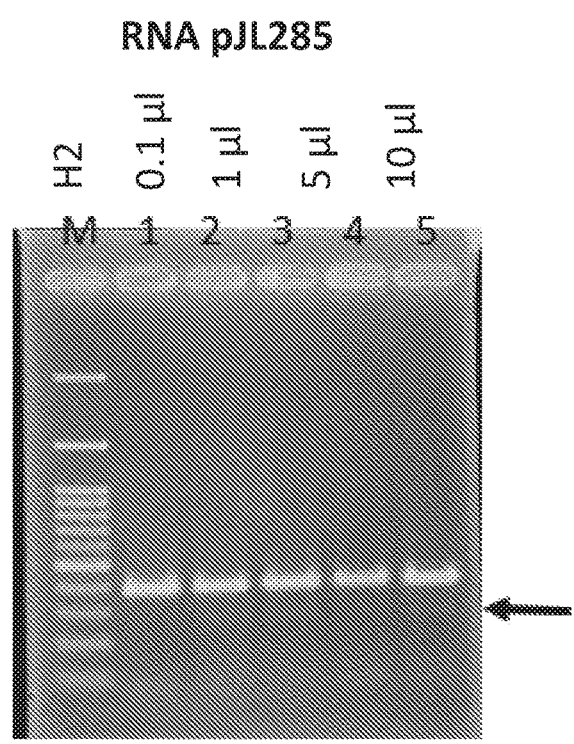
FIG. 18—Depicts an electrophoresis gel result showing T7E1 treatment of PCR products from tomato protoplast transfected by pJL 285 transcripts. PCR template in lane 1 was from tomato protoplasts which were not transfected with pJL 285 transcripts. Templates for PCR product in lanes 2 thru 5 were from four different tomato protoplast samples, each transfected with various amounts of pJL 285 transcript (0.1 μl, 1 μl, 5 μl, and 10 μl, respectively). Lane M contains NEB 100 bp ladder sequence. Arrow shows the location of the band expected if indels were formed by the action of CRISPR/Cas on the tomato VPE5 locus.

FIG. 18 shows T7E I treatment of PCR products from protoplast DNA. PCR template in lane 1 was from tomato protoplasts which were not transfected with pJL 285 transcripts. Templates for PCR product in lanes 2 thru 5 were from four different tomato protoplast samples, each transfected with various amounts of pJL 285 transcript (0.1 μl, 1 μl, 5 μl, and 10 μl, respectively). The transcription reaction was set up per manufacturers instructions (Ambion mMessage mMachine kit) with 0.5 to 1 ug template. After reaction was completed it was used directly in transformation. Lane M contains NEB 100 bp ladder sequence. Arrow shows the location of the band expected if indels were formed by the action of CRISPR/Cas on the tomato VPE5 locus. The results indicate that there were indels created in the tomato VPE5 gene, only in the tomato protoplasts which were transfected by transcripts of pJL 285.

Step 3: Estimation of Indel Frequency from Virus Expressed Crispr/Cas9 System

We sought to estimate the frequency of indels generated in the tomato genome after cleavage by the virus-expressed SpCas9 and single guide RNA (sgRNA). For this experiment, T7 transcripts of pJL 285 plasmid were transfected into tomato protoplasts using PEG and standard protocols.

Several days after transfection total DNA was extracted from transfected protoplasts. The DNA sequence targeted for cleavage by the Cas9/sgRNA expressed was amplified by PCR using primers flanking the targeted site (primers VPE5F (SEQ ID NO. 169) and VPE5R2 (SEQ ID NO. 171). This pair of primers produce a PCR product of about 650 bp, which contains the sequence targed by the sgRNA. The Cas9 nuclease was designed to cleave the tomato VPE5 gene at an MlyI restriction endonuclease site (GAGTC, SEQ ID NO. 167).

Figure 19:
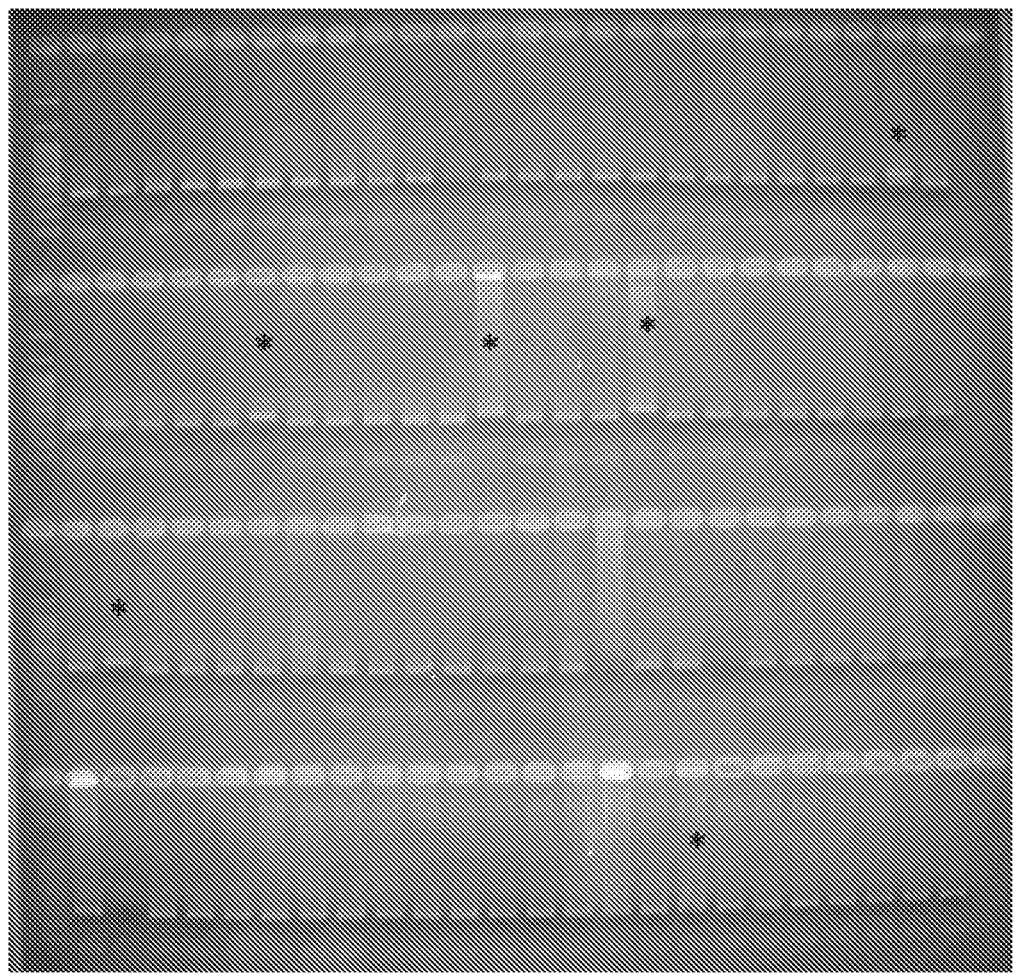
FIG. 19—Depicts an electrophoresis gel for estimating indel frequency. Among 93 individual $E.$ $coli$, colonies each of which contains DNA isolated from protoplast transfected by pJL 285 transcripts, indel mutation was observed in 6 clones (*).
Figure 20A:
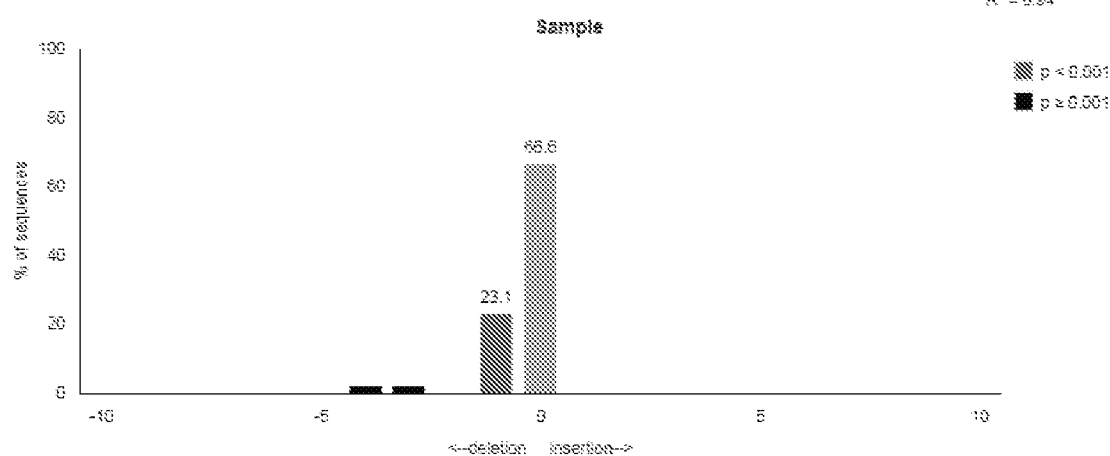
FIG. 20A and FIG. 20B—Depcit TIDE analysis results on plasmids isolated from $E.$ $coli$, colonies each of which contains DNA isolated from protoplast transfected by pJL 285 transcripts.
Figure 20B:
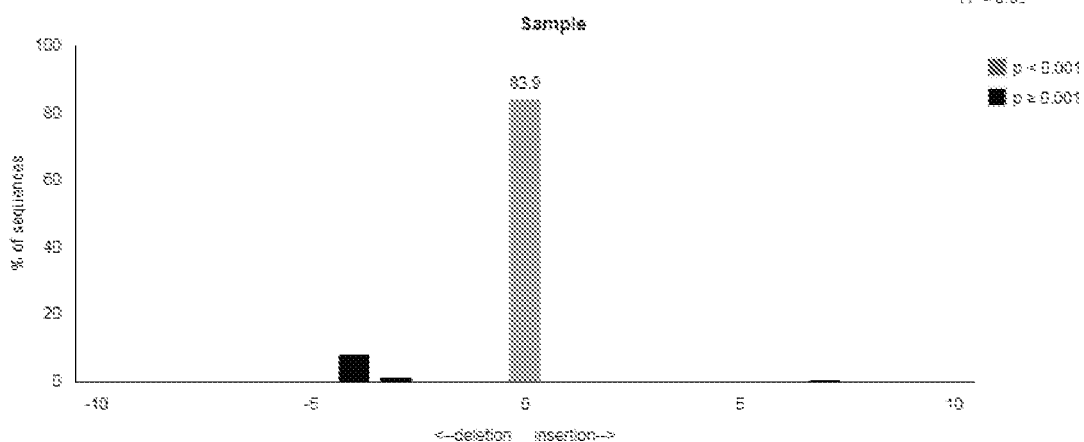

After PCR the amplified product was cloned into a standard cloning vector and transformed into E. coli. 96 individual colonies were picked and the inserts amplified with primers VPE5F and VPE5R. The resulting PCR products were then digested with MlyI. If an indel mutation was created after cleavage by Cas9 the MlyI site should be inactivated (destroyed). Therefore any PCR products that are resistant to cleavage by MlyI are from indel mutations. After screening 93 individual clones 6 MlyI resistant isolates were identified (FIG. 19). This represents an indel frequency of about 6.5% (6/93). Since not all of the tomato protoplasts transfected became infected with pJL 285 transcripts, so the actual indel frequency is actually higher. Plasmids of the E. coli colonies were also isolated and subjected to TIDE (Tracking of Indels by DEcomposition) analysis (see Brinkman et al., Nucleic Acids Res. 2014 Dec. 16; 42(22): e168., incorporated by reference in its entirety), the result of which is shown in FIG. 20.

These results demonstrate that a TMV based vector can express both a functional SpCas9 protein and sgRNA in tomato cells.

Example 9: Phenotype of Tomato Plants with VPE5 Gene Knock Out Mutations

To accomplish this objective seed generated from plants generated from Example 8 will be grown in greenhouse along with appropriate control (wild type VPE5) genotype. Fruit will be collected from plants and measured for Brix levels using refractometer. Other aspects of plant that will be phenotyped include total yield, number of flowers, trusses, flowering time. etc. to determine if VPE5 knock out mutations have any additional impact on tomatoes.

Example 10: Biolistic Delivery of Plasmids or RNAs Containing TMV Based Vectors to Plant Cells Biolistic delivery of pJL 159, pJL 165 or similar plasmids to cells. Using standard conditions gold particles will be coated with such plasmids. DNA coated beads will be biolistically delivered to leaf tissue. Several days post bombardment DNA will be extracted from bombarded tissue, digested with MlyI and then analyzed for indel mutations using the approach described above. One can envision bombarding tissues other than leaf tissues, such as meristems, immature embryos, etc. In some experiments, it will be desirable to let bombarded tissue regenerate or mature into a plant that flowers and sets seed. If cells which gave rise to germline cells were edited it will be possible to find DNA editing events in progeny.

Biolistic delivery of RNA to cells. Using standard conditions gold particles will be coated with T7 in vitro prepared transcripts of plasmids such as pJL 186, or pJL 187 or similar plasmids. RNA coated beads will be biolistically delivered to leaf tissue. Several days post bombardment RNA will be extracted from bombarded tissue, digested with MlyI and then analyzed for indel mutations using the approach described above. One can envision bombarding tissues other than leaf tissues, such as meristems, immature embryos, etc. In some experiments, it will be desirable to let bombarded tissue regenerate or mature into a plant which flowers and sets seed. If cells which gave rise to germline cells were edited it will be possible to find DNA editing events in progeny.

FURTHER EMBODIMENTS OF THE INVENTION

Other subject matter contemplated by the present disclosure is set out in the following numbered embodiments:

1. A recombinant self-replicating RNA, wherein said recombinant self-replicating RNA encodes at least one or more genes selected from the group consisting of:
   i) a replicase capable of transcribing the recombinant self-replicating RNA;
   ii) a movement protein facilitating intercellular movement of the RNA;
   iii) a Clustered regularly interspaced short palindromic repeats (CRISPR) endonuclease; and
   iv) at least one guide RNA;
   wherein said at least one guide RNA(s) is capable of directing sequence-specific binding of the CRISPR endonuclease to target DNA.

2. The recombinant self-replicating RNA of embodiment 1, wherein said recombinant self-replicating RNA encodes at least the following gene's combination:
   i) a replicase capable of transcribing the recombinant self-replicating RNA;
   iii) a Clustered regularly interspaced short palindromic repeats (CRISPR) endonuclease; and
   iv) at least one guide RNA:
   wherein said at least one guide RNA(s) is capable of directing sequence-specific binding of the CRISPR endonuclease to target DNA.

3. The recombinant self-replicating RNA of embodiment 1 or 2, wherein the recombinant self-replicating RNA is capable of intercellular movement in a plant host.

4. The recombinant self-replicating RNA of embodiment 1 or 2, wherein the CRISPR endonuclease is Cas9.

5. The recombinant self-replicating RNA of embodiment 1 or 2, wherein the RNA does not comprise a sequence encoding a coat protein.

6. The recombinant self-replicating RNA of embodiment 1 or 2, wherein the at least one guide RNA is expressed by a first subgenomic promoter and the CRISPR endonuclease is expressed by a second subgenomic promoter.

7. The recombinant self-replicating RNA of embodiments 1 to 6, wherein the first and/or second subgenomic promoter is a synthetic subgenomic promoter, or comprises the sequence according to SEQ ID No. 68.

8. The recombinant self-replicating RNA of embodiments 1 to 7, wherein the recombinant self-replicating RNA expresses a functional single-guide RNA (sgRNA), wherein the sgRNA has one or more additional nucleotides at its 5' and/or at its 3' end.

8.1 The recombinant self-replicating RNA of embodiments 1 to 8, wherein the at least one guide RNA when expressed from the recombinant self-replicating RNA comprises at least two extra nucleotides at its 5' and/or 3' end than would be expected if the same guide RNA were to be expressed by a RNA Polymerase III in an eukaryotic in vivo expression system.

9. The recombinant self-replicating RNA of embodiments 1 to 8.1, wherein the extra nucleotides at the 5' and/or 3' end of the at least one guide RNA is different from would be expected if the same guide RNA were to be expressed using a vector derived from the genome of Tobacco Rattle Virus (TRV).
10. The recombinant self-replicating RNA of embodiments 1 to 9, wherein the self-replicating RNA is derived from the genome of Tobacco Mosaic Virus (TMV).
11. The recombinant self-replicating RNA of embodiments 1 to 10, wherein the replicase shares at least 80% sequence identity to SEQ ID No. 71.
12. The recombinant self-replicating RNA of embodiments 1 to 11, wherein the movement protein shares at least 80% sequence identity to SEQ ID No. 74.
13. The recombinant self-replicating RNA of embodiments 1 to 12, wherein the CRISPR endonuclease comprises an amino acid sequence according to SEQ ID. No. 3.
14. The recombinant self-replicating RNA of embodiments 1 to 13, wherein the guide RNA comprises an nucleic acid sequence according to SEQ ID. No. 81.
15. A DNA vector comprising a polynucleotide encoding the recombinant self-replicating RNA of embodiment 1.
16. The DNA vector of embodiment 15, wherein the polynucleotide is operably linked to a promoter.
17. The DNA vector of embodiment 16, wherein the promoter is a promoter capable of expressing in a plant host organism.
17. The DNA vector of embodiment 16, wherein the promoter is a T7 promoter.
18. The DNA vector of embodiment 15, wherein the DNA vector is derived from the genome of Tobacco Mosaic Virus (TMV).
19. A method for editing the genome of a plant, said method comprising the steps of:
   a) introducing into a cell of the plant at least one recombinant self-replicating RNA, wherein said recombinant self-replicating RNA encodes at least one or more genes selected from the group consisting of:
      i) a replicase capable of transcribing the recombinant self-replicating RNA;
      ii) a movement protein facilitating intercellular movement of the RNA;
      iii) a Clustered regularly interspaced short palindromic repeats (CRISPR) endonuclease; and
      iv) at least one guide RNA, wherein said at least one guide RNA(s) is capable of directing sequence-specific binding of the CRISPR endonuclease to target DNA,
   wherein elements (i), (ii), (iii) and (iv) are expressed in the cell, and the CRISPR endonuclease cleaves the cell's genome at the selected target sequence, thereby editing the plant genome.
19.1. A genetically edited plant cell produced by the method of embodiment 19.
20. The method of embodiment 19 or 19.1, wherein the method comprise introducing into a cell of the plant a DNA sequence encoding the recombinant self-replicating RNA.
21. The method of embodiments 19 to 20, wherein the recombinant self-replicating RNA is not integrated into the genome of the cell.
22. The method embodiments 19 to 21, wherein the recombinant self-replicating RNA further encodes a iv) movement protein, wherein the movement protein is also expressed.
23. The method embodiment 22, wherein the recombinant self-replicating RNA is capable of intercellular movement in the plant.
24. The method embodiments 19 to 23, wherein the CRISPR endonuclease is Cas9.
25. The method of embodiments 19 to 24, wherein the introducing step comprises a step selected from the group consisting of i) agro infiltrating a DNA vector comprising a polynucleotide encoding the recombinant self-replicating RNA according to the invention into the plant cell; ii) contacting the recombinant self-replicating RNA according to the invention or a DNA vector comprising a polynucleotide encoding the recombinant self-replicating RNA with the plant cell; iii) electroporating the recombinant self-replicating RNA according to the invention, or a DNA vector comprising a polynucleotide encoding said recombinant self-replicating RNA into the plant cell, iv) mechanical inoculation and/or v) biolistically delivering the recombinant self-replicating RNA according to the invention, or a DNA vector comprising a polynucleotide encoding said recombinant self-replicating RNA into the plant cell.
25.1. A genetically edited plant cell produced by the method of embodiment 25.
26. The method of embodiments 19 to 25.1, further comprising step b) screening the cell of the plant for the presence of a mutation in the selected target sequence of the plant cell genome.
27. The method of embodiment 26, further comprising step c) regenerating the plant cell comprising the mutation identified in step (b) to produce a genetically edited plant.
27.1 The genetically edited plant created by the method of embodiment 27.
28. A composition comprising the recombinant self-replicating RNA of embodiments 1 to 14, in a phosphate buffer between pH 7-8.
29. A composition comprising the DNA vector of embodiment 15.
30. A cell comprising the recombinant self-replicating RNA of embodiments 1 to 14.
31. A cell comprising the DNA vector of embodiment 15.
32. A genetically edited plant of part thereof comprising at least one genetic mutation produced by the method of embodiments 19 to 25.1.
33. A method for producing a plant seed, wherein the method comprises crossing the genetically edited plant of embodiment 32 with a different, second plant of the same species, and harvesting the resultant seed, wherein the seed comprises the genetic mutation of the genetically edited plant.
33.1 The plant seed from the method of embodiment 33.
34. A method for producing a progeny plant, wherein the method comprises crossing the genetically edited plant of embodiment 27.2 or 32 with a different, second plant of the same species.
34.3 The progeny plant produced by the method of embodiment 34.
35. The method of embodiment 33, wherein the second plant comprises a gene that confers the progeny plant with a phenotype selected from the group consisting of male sterility, male fertility, herbicide resistance, insect resistance, disease resistance, water stress tolerance, and increased digestibility.
36. A method for producing nucleic acids, the method comprising isolating nucleic acids from the plant of embodiment 32.

37. A method for producing a second plant, the method comprising applying plant breeding techniques to the plant or plant part of embodiment 32 to produce the second plant.

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not, be taken as an acknowledgment or any form of suggestion that they constitute valid prior art or form part of the common general knowledge in any country in the world.

Unless defined otherwise, all technical and scientific terms herein have the same meaning as commonly understood by one of ordinary skill in the art to which this invention belongs. Although any methods and materials, similar or equivalent to those described herein, can be used in the practice or testing of the present invention, the preferred methods and materials are described herein. All publications, patents, and patent publications cited are incorporated by reference herein in their entirety for all purposes.

The publications discussed herein are provided solely for their disclosure prior to the filing date of the present application. Nothing herein is to be construed as an admission that the present invention is not entitled to antedate such publication by virtue of prior invention.

While the invention has been described in connection with specific embodiments thereof, it will be understood that it is capable of further modifications and this application is intended to cover any variations, uses, or adaptations of the invention following, in general, the principles of the invention and including such departures from the present disclosure as come within known or customary practice within the art to which the invention pertains and as may be applied to the essential features hereinbefore set forth and as follows in the scope of the appended claims.

SEQUENCES OF THE DISCLOSURE WITH SEQ ID NO IDENTIFIERS

| SEQ ID NO. | Source | Description |
|---|---|---|
| 1 | Campylobacter jejuni | Cas9 from Campylobacter jejuni |
| 2 | Pasteurella multocida | Cas9 from Pasteurella multocida |
| 3 | Streptococcus pyogenes | Cas9 from Streptococcus pyogenes |
| 4 | Streptococcus thermophilus | Cas9 from Streptococcus thermophilus |
| 5 | Neisseria meningitides | Cas9 from Neisseria meningitides |
| 6 | Streptococcus mutans | Cas9 from Streptococcus mutans |
| 7 | Francisella tularensis | Cpf1 from Francisella tularensis subsp. Novicida |
| 8 | Lachnospiraceae bacterium | Cpf1 from Lachnospiraceae bacterium MC2017 (Lb3Cpf1; pY005) |
| 9 | Butyrivibrio proteoclasticus | Cpf1 from Butyrivibrio proteoclasticus (Bp3Cpf1; pY006) |
| 10 | Peregrinibacteria bacterium | Cpf1 from Peregrinibacteria bacterium GW2011_GWA_33_10 (PeCpf1; pY007) |
| 11 | Parcubacteria bacterium | Cpf1 from Parcubacteria bacterium GWC2011_GWC2_44_17 (Pbcpf1; pY008) |

SEQUENCES OF THE DISCLOSURE WITH SEQ ID NO IDENTIFIERS —continued

| SEQ ID NO. | Source | Description |
|---|---|---|
| 12 | Smithella sp. | Cpf1 from Smithella sp. SC_K08D17 (SsCpf1; pY009) |
| 13 | Acidaminococcus sp. | Cpf1 from Acidaminococcus sp. BV3L6 (AsCpf1; pY010) |
| 14 | Lachnospiraceae bacterium | Cpf1 from Lachnospiraceae bacterium MA2020 (Lb2Cpf1; pY011) |
| 15 | Candidatus Methanoplasma termitum | Cpf1 from Candidatus Methanoplasma termitum (CMtCpf1; pY012) |
| 16 | Eubacterium eligens | Cpf1 from Eubacterium eligens (EeCpf1; pY013) |
| 17 | Moraxella bovoculi | Cpf1 from Moraxella bovoculi 237 (MbCpf1; pY014) |
| 18 | Leptospira inadai | Cpf1 from Leptospira inadai (LiCpf1; pY015) |
| 19 | Lachnospiraccae bacterium | Cpf1 from Lachnospiraceae bacterium ND2006 (LbCpf1; pY016) |
| 20 | Porphy romonas crevioricanis | Cpf1 from Porphyromonas crevioricanis (PcCpf1; pY017) |
| 21 | Prevotella disiens | Cpf1 from Prevotella disiens (PdCpf1; pY018) |
| 22 | Porphyromonas macacae | Cpf1 from Porphyromonas macacae (PmCpf1; pY09) |
| 23 | Pseudobutyrivibrio ruminis | Cpf1 from Pseudobutyrivibrio ruminis Genbank WP_028248456 Cpf1 |
| 24 | Proteocatella sphenisci | Cpf1 from Proteocatella sphenisci Genbank WP_028830240 Cpf1 |
| 25 | Butyrivibrio sp. | Cpf1 from Butyrivibrio sp. Genbank WP_035798880 Cpf1 |
| 26 | Moraxella caprae | Cpf1 from Moraxella caprae Genbank WP_p36388671 Cpf1 |
| 27 | Synergistes jonesii | Cpf1 from Synergistes jonesii Genbank WP_037975888 Cpf1 |
| 28 | Prevotella brevis | Cpf1 from Prevotella brevis Genbank WP_044110123 Cpf1 |
| 29 | Flavobacterium sp. | Cpf1 from Flavobacterium sp. Genbank WP_045971446 Cpf1 |
| 30 | Sneathia amnii | Cpf1 from Sneathia amnii Genbank WP_046328599 Cpf1 |
| 31 | Candidatus Methanoplasma | Cpf1 from Candidatus Methanoplasma Genbank WP_048112740 Cpf1 |
| 32 | Oribacterium sp. | Cpf1 from Oribacterium sp. Genbank WP_J49895985 Cpf1 |
| 33 | Prevotella disiens | Cpf1 from Prevotella disiens Genbank WP_050786240 Cpf1 |
| 34 | Arcobacter butzleri | Cpf1 from Arcobacter butzleri Genbank WP_052943011 Cpf1 |
| 35 | Treponema endosymbiont | Cpf1 from Treponema endosymbiont of Eucomonympha sp. Genbank WP_062376669 Cpf1 |
| 36 | Moraxella lacunata | Caft from Moraxella lacunata Genbank WP_062499108 Cpf1 |
| 37 | Francisella philomiragia | Cpf1 from Francisella philomiragia subsp. Genbank ABZ87876 Cpf1 |
| 38 | Francisella philomiragia | Cpf1 from Francisella philomiragia subsp. Genbank ABZ87877 Cpf1 |
| 39 | Francisella philomiragia | Cpf1 from Francisella philomiragia subspp. Genbank AJI56734 Cpf1 |
| 40 | Moraxella bovoculi | Cpf1 from Moraxella bovoculi Genbank AKG08867 Cpf1 |
| 41 | Eubacterium eligens. | Cpf1 from Eubacterium eligens. Genbank CDA41776 Cpf1 |
| 42 | Eubacterium rectale | Cpf1 from Eubacterium rectale. Genbank CUM80100 Cpf1 |
| 43 | unknown | Cpf1 from Uncultured Bacterium. Genbank EKE06926 Cpf1 |
| 44 | unknown | Cpf1 from Uncultured Bacterium. Genbank EKE28449 Cpf1 |

SEQUENCES OF THE DISCLOSURE WITH SEQ ID NO IDENTIFIERS

| SEQ ID NO. | Source | Description |
|---|---|---|
| 45 | *Smithella* sp. | Cpf1 from *Smithella* sp. Genbank KFO67989 Cpf1 |
| 46 | *Candidatus Peregrinibacteria* | Cpf1 from *Candidatus Peregrinibacteria* Genbank KKP36646 Cpf1 |
| 47 | *Candidatus Roizmanbacteria* | Cpf1 from *Candidatus Roizmanbacteria bacterium* Genbank KKQ38174 Cpf1 |
| 48 | *Candidatus Falkowbacteria* | Cpf1 from *Candidatus Falkowbacteria bacterium* Genbank KKR91555 Cpf1 |
| 49 | *Parcubacteria* sp. | Cpf1 from *Parcubacteria* group bacterium Genbank KKT48220 Cpf1 |
| 50 | *Thiomicrospira* sp. | Cpf1 from *Thiomicrospira* sp. Genbank KUJ74576 Cpf1 |
| 51 | *Bacteroidales bacterium* | Cpf1 from *Bacteroidales bacterium* Genbank KXB38146 Cpf1 |
| 52 | *Francisella tularensis* | Cpf1 from *Francisella tularensis* Genbank WP_003040289 Cpf1 |
| 53 | *Helcococcus kunzii* | Cpf1 from *Helcococcus kunzii* Genbank WP_005398606 Cpf1 |
| 54 | *Prevotella bryantii* | Cpf1 from *Prevotella bryantii* Genbank WP_006283774 Cpf1 |
| 55 | *Bacteroidetes* oral | Cpf1 from *Bacteroidetes* oral Genbank WP_009217842 Cpf1 |
| 56 | *Flavobacterium branchiophilum* | Cpf1 from *Flavobacterium branchiophilum* Genbank WP_014085038 Cpf1 |
| 57 | *Lachnospiraceaa bacterium* | Cpf1 from *Lachnospiraceae bacterium* Genbank WP_16301126 Cpf1 |
| 58 | *Porphyromonas macacae* | Cpf1 from *Porphyromonas macacae* Genbank WP_018359861 Cpf1 |
| 59 | *Synergistes jonesii* | Cpf1 from *Synergistes jonesii* Type V CV CRISPR-associated protein WP_037975888 Cpf1 |
| 60 | *Leptospira inadai* | Cpf1 from *Leptospira inadai* Genbank WP_020988726 Cpf1 |
| 61 | *Porphyromonas crevioricanis* | Cpf1 from *Porphyromonas crevioricanis* Genbank WP_023941260 Cpf1 |
| 62 | *Prevotella albensis* | Cpf1 from *Prevotella albensis* Genbank WP_024988992 Cpf1 |
| 63 | *Butyrivibrio fibrisolvens* | Cpf1 from *Butyrivibrio fibrisolvens* Genbank WP_027216152 Cpf1 |
| 64 | *Anaerovibrio* sp. | Cpf1 from *Anaerovibrio* sp. Genbank WP_027407524 Cpf1 |
| 65 | Tobacco mosaic virus | Subgenomic promoter for Cas9 from pJL186 |
| 66 | Tobacco mosaic virus | Subgenomic promoter for Cas9 from pJL187 |
| 67 | Tobacco mosaic virus | Subgenomic promoter for gRNA from pJL187 |
| 68 | artificial sequence | Synthetic Subgenomic promoter; engineered to fold into a structure similar to that of the U1 wild type subgenomic promoter |
| 69 | Tobacco Mosaic Virus | Tobacco Mosaic Virus Replicase DNA sequence |
| 70 | Tobacco Mosaic Virus | Sequence of guide RNA expressed by pJL 122 |
| 71 | Tobacco Mosaic Virus | Tobacco Mosaic Virus Replicase Polypeptide sequence |
| 72 | Tomato mosaic Virus | Tomato mosaic Virus Replicase Polypeptide sequence Genbank ID CBN73321.1 |
| 73 | Tobacco Mosaic Virus | Tobacco Mosaic Virus Movement Protein DNA coding sequence |
| 74 | Tobacco Mosaic Virus | Tobacco Mosaic Virus Movement Protein Polypeptide sequence |
| 75 | Tobacco Mosaic Virus | Tobacco Mosaic Virus Coat Protein DNA coding sequence |
| 76 | Tobacco Mosaic Virus | Tobacco Mosaic Virus Coat Protein Polypeptide sequence |
| 77 | artificial sequence | Protospacer Adjacent motif for Cpf1 |
| 78 | artificial sequence | Protospacer Adjacent motif for Cas9 of *S. thermophilus* |
| 79 | artificial sequence | Protospacer Adjacent motif for Cas9 of *S. pyogenes* |
| 80 | artificial sequence | Protospacer Adjacent motif for Cas9 of *S. thermophilus* |
| 81 | artificial sequence | Guide RNA Sequence |
| 82 | artificial sequence | pJL 128 vector |
| 83 | artificial sequence | pJL 155 vector |
| 84 | artificial sequence | pJL 165 vector |
| 85 | artificial sequence | pJL 186 vector |
| 86 | artificial sequence | pJL 187 vector |
| 87 | artificial sequence | MlyI restriction enzyme recognition site |
| 88 | artificial sequence | pJL 125 vector |
| 89 | artificial sequence | pJL 122 vector |
| 90 | artificial sequence | Predicted sequence of guide RNA expressed by pJL 155 |
| 91 | artificial sequence | pJL 159 vector |
| 92 | artificial sequence | pJL 164 vector |
| 93 | artificial sequence | Predicted guide RNA produced from pJL 165 |
| 94 | artificial sequence | Predicted guide RNA produced from pJL 159 |
| 95 | artificial sequence | Selected deletion from 775.seq |
| 96 | artificial sequence | Selected deletion from 775.seq |
| 97 | artificial sequence | Selected deletion from 284.seq |
| 98 | artificial sequence | Selected deletion from 284.seq |
| 99 | artificial sequence | Sequence in FIG. 3B; Example of Cas9 triggered indel mutation recovered from transient expression of pJL 122 and pJL 125 T-DNAs in *N. benthamiana* cells |
| 100 | artificial sequence | Sequence in FIG. 3B; Example of Cas9 triggered indel mutation recovered from transient expression of pJL 122 and pJL 125 T-DNAs in *N. benthamiana* cells |
| 101 | artificial sequence | Sequence in FIG. 3B; Example of Cas9 triggered indel mutation recovered from transient expression of pJL 122 and pJL 125 T-DNAs in *N. benthamiana* cells |
| 102 | artificial sequence | Sequence in FIG. 3B; Example of Cas9 triggered indel mutation recovered from transient expression of pJL 122 and pJL 125 T-DNAs in *N. benthamiana* cells |
| 103 | artificial sequence | Sequence in FIG. 3B; Example of Cas9 triggered indel mutation recovered from transient expression of pJL 122 and pJL 125 T-DNAs in *N. benthamiana* cells |
| 104 | artificial sequence | Sequence in FIG. 3B; Example of Cas9 triggered indel mutation recovered from transient expression of pJL 122 and pJL 125 T-DNAs in *N. benthamiana* cells |
| 105 | artificial sequence | Sequence in FIG. 3B; Example of Cas9 triggered indel mutation recovered from transient expression of pJL 122 and pJL 125 T-DNAs in *N. benthamiana* cells |

| SEQ ID NO. | Source | Description |
|---|---|---|
| 106 | artificial sequence | Sequence in FIG. 4B; Sequence of indel mutation recovered from expression of Cas9 from TMV vector and sgRNA from pJL 122 in *N. benthamiana* cells |
| 107 | artificial sequence | Sequence in FIG. 4B; Sequence of indel mutation recovered from expression of Cas9 from TMV vector and sgRNA from pJL 122 in *N. benthamiana* cells |
| 108 | artificial sequence | Sequence in FIG. 4B; Sequence of indel mutation recovered from expression of Cas9 from TMV vector and sgRNA from pJL 122 in *N. benthamiana* cells |
| 109 | artificial sequence | Sequence in FIG. 4B; Sequence of indel mutation recovered from expression of Cas9 from TMV vector and sgRNA from pJL 122 in *N. benthamiana* cells |
| 110 | artificial sequence | Sequence in FIG. 4B; Sequence of indel mutation recovered from expression of Cas9 from TMV vector and sgRNA from pJL 122 in *N. benthamiana* cells |
| 111 | artificial sequence | Sequence in FIG. 4B; Sequence of indel mutation recovered from expression of Cas9 from TMV vector and sgRNA from pJL 122 in *N. benthamiana* cells |
| 112 | artificial sequence | Sequence in FIG. 5B; Example of Cas9 triggered indel mutation recovered from transient expression of Cas9 from pJL 125 T-DNA and sgRNA from the TMV vector in pJL 155 in *N. benthamiana* cells |
| 113 | artificial sequence | Sequence in FIG. 5B; Example of Cas9 triggered indel mutation recovered from transient expression of Cas9 from pJL 125 T-DNA and sgRNA from the TMV vector in pJL 155 in *N. benthamiana* cells |
| 114 | artificial sequence | Sequence in FIG. 5B; Example of Cas9 triggered indel mutation recovered from transient expression of Cas9 from pJL 125 T-DNA and sgRNA from the TMV vector in pJL 155 in *N. benthamiana* cells |
| 115 | artificial sequence | Sequence in FIG. 5B; Example of Cas9 triggered indel mutation recovered from transient expression of Cas9 from pJL 125 T-DNA and sgRNA from the TMV vector in pJL 155 in *N. benthamiana* cells |
| 116 | artificial sequence | Sequence in FIG. 5B; Example of Cas9 triggered indel mutation recovered from transient expression of Cas9 from pJL 125 T-DNA and sgRNA from the TMV vector in pJL 155 in *N. benthamiana* cells |
| 117 | artificial sequence | Sequence in FIG. 5B; Example of Cas9 triggered indel mutation recovered from transient expression of Cas9 from pJL 125 T-DNA and sgRNA from the TMV vector in pJL 155 in *N. benthamiana* cells |
| 118 | artificial sequence | Sequence in FIG. 5B; Example of Cas9 triggered indel mutation recovered from transient expression of Cas9 from pJL 125 T-DNA and sgRNA from the TMV vector in pJL 155 in *N. benthamiana* cells |
| 119 | artificial sequence | Sequence in FIG. 6B; Example of indel mutation recovered from leaf cells infiltrated (exposed to) *Agrobacterium* cultures carrying pJL 159 |
| 120 | artificial sequence | Sequence in FIG. 6B; Example of indel mutation recovered from leaf cells infiltrated (exposed to) *Agrobacterium* cultures carrying pJL 159 |
| 121 | artificial sequence | Sequence in FIG. 6B; Example of indel mutation recovered from leaf cells infiltrated (exposed to) *Agrobacterium* cultures carrying pJL 159 |
| 122 | artificial sequence | Sequence in FIG. 6B; Example of indel mutation recovered from leaf cells infiltrated (exposed to) *Agrobacterium* cultures carrying pJL 159 |
| 123 | artificial sequence | Sequence in FIG. 6B; Example of indel mutation recovered from leaf cells infiltrated (exposed to) *Agrobacterium* cultures carrying pJL 159 |
| 124 | artificial sequence | Sequence in FIG. 6B; Example of indel mutation recovered from leaf cells infiltrated (exposed to) *Agrobacterium* cultures carrying pJL 159 |
| 125 | artificial sequence | Sequence in FIG. 6C; Example of indel mutation recovered from leaf cells infiltrated (exposed to) *Agrobacterium* cultures carrying pJL 159 |
| 126 | artificial sequence | Sequence in FIG. 6C; Example of indel mutation recovered from leaf cells infiltrated (exposed to) *Agrobacterium* cultures carrying pJL 159 |
| 127 | artificial sequence | Sequence in FIG. 6C; Example of indel mutation recovered from leaf cells infiltrated (exposed to) *Agrobacterium* cultures carrying pJL 159 |
| 128 | artificial sequence | Sequence in FIG. 6C; Example of indel mutation recovered from leaf cells infiltrated (exposed to) *Agrobacterium* cultures carrying pJL 159 |
| 129 | artificial sequence | Sequence in FIG. 6C; Example of indel mutation recovered from leaf cells infiltrated (exposed to) *Agrobacterium* cultures carrying pJL 159 |
| 130 | artificial sequence | Sequence in FIG. 9 for pJL186; Indel mutation recovered from plant cells infected with the recombinant self-replicating RNA produced by T7 in vitro transcription reactions of the pJL 186 vector and the pJL 187 vector |
| 131 | artificial sequence | Sequence in FIG. 9 for pJL186; Indel mutation recovered from plant cells infected with the |

SEQUENCES OF THE DISCLOSURE WITH SEQ ID NO IDENTIFIERS

| SEQ ID NO. | Source | Description |
|---|---|---|
| 132 | artificial sequence | Sequence in FIG. 9 for pJL186; Indel mutation recovered from plant cells infected with the recombinant self-replicating RNA produced by T7 in vitro transcription reactions of the pJL 186 vector and the pJL 187 vector |
| 133 | artificial sequence | Sequence in FIG. 9 for pJL186; Indel mutation recovered from plant cells infected with the recombinant self-replicating RNA produced by 17 in vitro transcription reactions of the pJL 186 vector and the pJL 187 vector |
| 134 | artificial sequence | Sequence in FIG. 9 for pJL186; Indel mutation recovered from plant cells infected with the recombinant self-replicating RNA produced by T7 in vitro transcription reactions of the pJL 186 vector and the pJL 187 vector |
| 135 | artificial sequence | Sequence in FIG. 9 for pJL186; Indel mutation recovered from plant cells infected with the recombinant self-replicating RNA produced by T7 in vitro transcription reactions of the pJL 186 vector and the pJL 187 vector |
| 136 | artificial sequence | Sequence in FIG. 9 for pJL186; Indel mutation recovered from plant cells infected with the recombinant self-replicating RNA produced by T7 in vitro transcription reactions of the pJL 186 vector and the pJL 187 vector |
| 137 | artificial sequence | Sequence in FIG. 9 for pJL186; Indel mutation recovered from plant cells infected with the recombinant self-replicating RNA produced by T7 in vitro transcription reactions of the pJL 186 vector and the pJL 187 vector |
| 138 | artificial sequence | Sequence in FIG. 9 for pJL186; Indel mutation recovered from plant cells infected with the recombinant self-replicating RNA produced by T7 in vitro transcription reactions of the pJL 186 vector and the pJL 187 vector |
| 139 | artificial sequence | Sequence in FIG. 9 for pJL 187; Indel mutation recovered from plant cells infected with the recombinant self-replicating RNA produced by T7 in vitro transcription reactions of the pJL 186 vector and the pJL 187 vector |
| 140 | artificial sequence | Sequence in FIG. 9 for pJL187; Indel mutation recovered from plant cells infected with the recombinant self-replicating RNA produced by T7 in vitro transcription reactions of the pJL 186 vector and the pJL 187 vector |
| 141 | artificial sequence | Sequence in FIG. 9 for pJL187; Indel mutation recovered from plant cells infected with the recombinant self-replicating RNA produced by T7 in vitro transcription reactions of the pJL 186 vector and the pJL 187 vector |
| 142 | artificial sequence | Sequence in FIG. 9 for pJL187; Indel mutation recovered from plant cells infected with the recombinant self-replicating RNA produced by T7 in vitro transcription reactions of the pJL 186 vector and the pJL 187 vector |
| 143 | artificial sequence | Sequence in FIG. 9 for pJL187; Indel mutation recovered from plant cells infected with the recombinant self-replicating RNA produced by 17 in vitro transcription reactions of the pJL 186 vector and the pJL 187 vector |
| 144 | artificial sequence | Sequence in FIG. 9 for pJL187; Indel mutation recovered from plant cells infected with the recombinant self-replicating RNA produced by T7 in vitro transcription r reactions of the pJL 186 vecto and the pJL 187 vector |
| 145 | artificial sequence | Sequence in FIG. 9 for pJL187; Indel mutation recovered from plant cells infected with the recombinant self-replicating RNA produced by T7 in vitro transcription reactions of the pJL 186 vector and the pJL 187 vector |
| 146 | artificial sequence | Illustrative transcriptional start site for subgenomic promoters of the present disclosure |
| 147 | artificial sequence | Illustrative example of minimally active subgenomic promoters of the present disclosure |
| 148 | artificial sequence | Illustrative example of fully active subgenomic promoters of the present disclosure |
| 149 | Tomato mottle mosaic virus | Tomato mottle mosaic virus RNA-dependent RNA polymerase |
| 150 | Tomato brown rugose fruit virus | Tomato brown mgose fruit virus RNA-dependent RNA polymerase |
| 151 | *Rehmannia* mosaic virus | *Rehmannia* mosaic virus RNA-dependent RNA polymerase |
| 152 | Pepper mild mottle virus | Pepper mild mottle virus Replicase |
| 153 | Tropical soda apple mosaic virus | Tropical soda apple mosaic virus Replicase |
| 154 | *Brugmansia* mild mottle virus | *Brugmansia* mild mottle virus Replicase |
| 155 | Yellow tailflower mild mottle virus | Yellow tailflower mild mottle virus Replicase |
| 156 | Paprika mild mottle virus | Paprika mild mottle virus Replicase |
| 157 | Obuda pepper virus | Obuda pepper virus Replicase |
| 158 | Tobacco mild green mosaic virus | Tobacco mild green mosaic virus Replicase |
| 159 | artificial sequence | amplified sequence encoding for part of the TMV subgenomic RNA promoter, transcription start site for TMV subgenomic RNA synthesis a leader sequence and, at its very 3' end a spacer sequence of the tomato VPE5 gene, using plasmid pJL 165 as a template and primers JAL 563 and JAL 778 |
| 160 | artificial sequence | spacer sequence of the tomato VPE5 gene |

| SEQUENCES OF THE DISCLOSURE WITH SEQ ID NO IDENTIFIERS | | |
|---|---|---|
| SEQ ID NO. | Source | Description |
| 161 | artificial sequence | amplified sequence encoding sgRNA (with spacer for tomato VPE5 gene)-TRBO 3' UTS-Ribozyme-35S terminator-Right Border, using plasmid pJL 132 as a template and primers JAL 753 and JAL 766; nt positions: 1-20: spacer sequence of the tomato VPE5 gene 21-96: gRNA scaffold 108-310: 3' UTS of TRBO 315-408: Ribozyme 409-617: 35S terminator |

| SEQUENCES OF THE DISCLOSURE WITH SEQ ID NO IDENTIFIERS | | |
|---|---|---|
| SEQ ID NO. | Source | Description |
| | | 685-709: RB T-DAN repeat |
| 162 | Artificial sequence | SOE PCR product (joining SEQ ID No. 159 and SEQ ID No. 161) |
| 163 | Artificial sequence | Primer JAL 563 |
| 164 | Artificial sequence | Primer JAL 753 |
| 165 | Artificial sequence | Primer JAL 766 |
| 166 | Artificial sequence | Primer JAL 778 |
| 167 | Artificial sequence | MiyI restriction endonuclease site |
| 168 | Tobacco Mosaic Virus | Tobacco Mosaic Virus (TMV) RNA dependent RNA polymerase |
| 169 | Artificial sequence | VPE5 locus primer-forward |
| 170 | Artificial sequence | VPE5 locus primer-reverse |
| 171 | Artificial sequence | VPE5 locus primer-reverse 2 |

SEQUENCE LISTING (171 sequences)

SEQ ID NO: 1 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 2 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 3 - protein, 1368 aa, Streptococcus pyogenes [sequence omitted]

SEQ ID NO: 4 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 5 - protein, 1082 aa, Neisseria meningitides
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 6 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 7 - protein, 1345 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNKRPAATKKAGQAKKKKGSYPYDVPDYAYPYDVPDYAYPYDVPDYA

SEQ ID NO: 8 - protein, 1278 aa, Lachnospiraceae bacterium
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKLLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLINKRPAATKKAGQAKKKKGSYPYDVPDYAYPYDVPDYAYPYDVPDYA

SEQ ID NO: 9 - protein, 1345 aa, Butyrivibrio proteoclasticus; identical to SEQ ID NO: 7

SEQ ID NO: 10 - protein, 1522 aa, Peregrinibacteria bacterium
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEDKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAIMKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTEIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDCWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKKAGQAKKKKGSYPYDVPDYAYPYDVPDYAYPYDVPDYA

SEQ ID NO: 11 - protein, 1397 aa, Parcubacteria bacterium
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDHKRPAATKKAGQAKKKKGSYPYDVPDYAYPYDVPDYAYPYDVPDYA

SEQ ID NO: 12 - protein, 1295 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYAWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKGKRPAATKKAGQAKKKKGSYPYDVPDYAYPYDVPDYAYPYDVPDYA

SEQ ID NO: 13 - protein, 1352 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKGSYPYDVPDYAYPYDVPDYAYPYDVPDYA

SEQ ID NO: 14 - protein, 1251 aa, Lachnospiraceae bacterium
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGYLSQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLLKRPAATKKAGQAKKKKGSYPYDVPDYAYPYDVPDYAYPYDVPDYA

SEQ ID NO: 15 - protein, 1283 aa, Candidatus Methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGDKRPAATKKAGQAKKKKGSYPYDVPDYAYPYDVPDYAYPYDVPDYA

SEQ ID NO: 16 - protein, 1327 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYEKRPAATKKAGQAKKKKGSYPYDVPDYAYPYDVPDYAYPYDVPDYA

SEQ ID NO: 17 - protein, 1418 aa, Moraxella bovoculi
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNRKRPAATKKAGQAKKKKGSYPYDVPDYAYPYDVPDYAYPYDVPDYA

SEQ ID NO: 18 - protein, 1308 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNRKRPAATKKAGQAKKKKGSYPYDVPDYAYPYDVPDYAYPYDVPDYA

SEQ ID NO: 19 - protein, 1272 aa, Lachnospiraceae bacterium
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHKRPAATKKAGQAKKKKGSYPYDVPDYAYPYDVPDYAYPYDVPDYA

SEQ ID NO: 20 - protein, 1305 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKDKRPAATKKAGQAKKKKGSYPYDVPDYAYPYDVPDYAYPYDVPDYA

SEQ ID NO: 21 - protein, 1368 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLKKRPAATKKAGQAKKKKGSYPYDVPDYAYPYDVPDYAYPYDVPDYA

SEQ ID NO: 22 - protein, 1291 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVEKRPAATKKAGQAKKKKGSYPYDVPDYAYPYDVPDYAYPYDVPDYA

SEQ ID NO: 23 - protein, 1205 aa, Pseudobutyrivibrio ruminis
MYYQNLTKMYPISKTLRNELIPVGKTLENIRKNGILEADIQRKADYEHVKKLMDNYHKQLINEALQGVHLSDLSDAYDLYFNLSKEKNSVDAFSKCQDKLRKEIVSLLKNHENFPKIGNKEIIKLLQSLYDNDTDYKALDSFSNFYTYFSSYNEVRKNLYSDEEKSSTVAYRLINENLPKFLDNIKAYAIAKKAGVRAEGLSEEDQDCLFIIETFERTLTQDGIDNYNAAIGKLNTAINLFNQQNKKQEGFRKVPQMKCLYKQILSDREEAFIDEFSDDEDLITNIESFAENMNVFLNSEIITDFKIALVESDGSLVYIKNDVSKTSFSNIVFGSWNAIDEKLSDEYDLANSKKKKDEKYYEKRQKELKKNKSYDLETIIGLFDDNSDVIGKYIEKLESDITAIAEAKNDFDEIVLRKHDKNKSLRKNTNAVEAIKSYLDTVKDFERDIKLINGSGQEVEKNLVVYAEQENILAEIKNVDSLYNMSRNYLTQKPFSTEKFKLNFNRATLLNGWDKNKETDNLGILFEKDGMYYLGIMNTKANKIFVNIPKATSNDVYHKVNYKLLPGPNKMLPKVFFAQSNLDYYKPSEELLAKYKAGTHKKGDNFSLEDCHALIDFFKASIEKHPDWSSFGFEFSETCTYEDLSGFYREVEKQGYKITYTDVDADYITSLVERDELYLFQIYNKDFSPYSKGNLNLHTIYLQMLFDQRNLNNVVYKLNGEAEVFYRPASINDEEVIIHKAGEEIKNKNSKRAVDKPTSKFGYDIIKDRRYSKDKFMLHIPVTMNFGVDETRRFNDVVNDALRNDEKVRVIGIDRGERNLLYVVVVDTDGTILEQISLNSIINNEYSIETDYHKLLDEKEGDRDRARKNWTTIENIKELKEGYLSQVVNVIAKLVLKYNAIICLEDLNFGFKRGRQKVEKQVYQKFEKMLIDKLNYLVIDKSRKQDKPEEFGGALNALQLTSKFTSFKDMGKQTGIIYYVPAYLTSKIDPTTGFANLFYVKYENVEKAKEFFSRFDSISYNNESGYFEFAFDYKKFTDRACGARSQWTVCTYGERIIKFRNTEKNNSFDDKTIVLSEEFKELFSIYGISYEDGAELKNKIMSVDEADFFRSLTRLFQQTMQMRNSSNDVTRDYIISPIMNDRGEFFNSEACDASKPKDADANGAFNIARKGLWVLEQIRNTPSGDKLNLAMSNAEWLEYAQRNQI

SEQ ID NO: 24 - protein, 1154 aa, Proteocatella sphenisci
MENFKNLYPINKTLRFELRPYGKTLENFKKSGLLEKDAFKANSRRSMQAIIDEKFKETIEERLKYTEFSECDLGNMTSKDKKITDKAATNLKKQVILSFDDEIFNNYLKPDKNIDALFKNDPSNPVISTFKGFTTYFVNFFEIRKHIFKGESSGSMAYRIIDENLTTYLNNIEKIKKLPEELKSQLEGIDQIDKLNNYNEFITQSGITHYNEIIGGISKSENVKIQGINEGINLYCQKNKVKLPRLTPLYKMILSDRVSNSFVLDTIENDTELIEMISDLINKTEISQDVIMSDIQNIFIKYKQLGNLPGISYSSIVNAICSDYDNNFGDGKRKKSYENDRKKHLETNVYSINYISELLTDTDVSSNIKMRYKELEQNYQVCKENFNATNWMNIKNIKQSEKTNLIKDLLDILKSIQRFYDLFDIVDEDKNPSAEFYTWLSKNAEKLDFEFNSVYNKSRNYLTRKQYSDKKIKLNFDSPTLAKGWDANKEIDNSTIIMRKFNNDRGDYDYFLGIWNKSTPANEKIIPLEDNGLFEKMQYKLYPDPSKMLPKQFLSKIWKAKHPTTPEFDKKYKEGRHKKGPDFEKEFLHELIDCFKHGLVNHDEKYQDVFGFNLRNTEDYNSYTEFLEDVERCNYNLSFNKIADTSNLINDGKLYVFQIWSKDFSIDSKGTKNLNTIYFESLFSEENMIEKMFKLSGEAEIFYRPASLNYCEDIIKKGHHHAELKDKFDYPIIKDKRYSQDKFFFHVPMVINYKSEKLNSKSLNNRTNENLGQFTHIIGIDRGERHLIYLTVVDVSTGEIVEQKHLDEIINTDTKGVEHKTHYLNKLEEKSKTRDNERKSWEAIETIKELKEGYISHVINEIQKLQEKYNALIVMENLNYGFKNSRIKVEKQVYQKFETALIKKFNYIIDKKDPETYIHGYQLTNPITTLDKIGNQSGIVLYIPAWNTSKIDPVTGFVNLLYADDLKYKNQEQAKSFIQKIDNIYFENGEFKFDIDFSKWNNRYSISKTKWTLTSYGTRIQTFRNPQKNNKWDSAEYDLTEEFKLILNIDGTLKSQDVETYKKFMSLFKLMLQLRNSVTGTDIDYMISPVTDKTGTHFDSRENIKNLPADADANGAYNIARKGIMAIENIMNGISDPLKISNEDYLKYIQNQQE

SEQ ID NO: 25 - protein, 1206 aa, Butyrivibrio sp.
MYYQNLTKKYPVSKTIRNELIPIGKTLENIRKNNILESDVKRKQDYEHVKGIMDEYHKQLINEALDNYMLPSLNQAAEIYLKKHVDVEDREEFKKTQDLLRREVTGRLKEHENYTKIGKKDILDLLEKLPSISEEDYNALESFRNFYTYFTSYNKVRENLYSDEEKSSTVAYRLINENLPKFLDNIKSYAFVKAAGVLADCIEEEEQDALFMVETFNMTLTQEGIDMYNYQIGKVNSAINLYNQKNHKVEEFKKIPKMKVLYKQILSDREEVFIGEFKDDETLLSSIGAYGNVLMTYLKSEKINIFFDALRESEGKNVYVKNDLSKTTMSNIVFGSWSAFDELLNQEYDLANENKKKDDKYFEKRQKELKKNKSYTLEQMSNLSKEDISPIENYIERISEDIEKICIYNGEFEKIVVNEHDSSRKLSKNIKAVKVIKDYLDSIKELEHDIKLINGSGQELEKNLVVYVGQEEALEQLRPVDSLYNLTRNYLTKKPFSTEKVKLNFNKSTLLNGWDKNKETDNLGILFFKDGKYYLGIMNTTANKAFVNPPAAKTENVFKKVDYKLLPGSNKMLPKVFFAKSNIGYYNPSTELYSNYKKGTHKKGPSFSIDDCHNLIDFFKESIKKHEDWSKFGFEFSDTADYRDISEFYREVEKQGYKLTFTDIDESYINDLIEKNELYLFQIYNKDFSEYSKGKLNLHTLYFMMLFDQRNLDNVVYKLNGEAEVFYRPASIAENELVIHKAGEGIKNKNPNRAKVKETSTFSYDIVKDKRYSKYKFTLHIPITMNFGVDEVRRFNDVINNALRTDDNVNVIGIDRGERNLLYVVVINSEGKILEQISLNSIINKEYDIETNYHALLDEREDDRNKARKDWNTIENIKELKTGYLSQVVNVVAKLVLKYNAIICLEDLNFGFKRGRQKVEKQVYQKFEKMLIEKLNYLVIDKSREQVSPEKMGGALNALQLTSKFKSFAELGKQSGIIYYVPAYLTSKIDPTTGFVNLFYIKYENIEKAKQFFDGFDFIRFNKKDDMFEFSFDYKSFTQKACGIRSKWIVYTNGERIIKYPNPEKNNLFDEKVINVTDEIKGLFKQYRIPYENGEDIKEIIISKAEADFYKRLFRLLHQTLQMRNSTSDGTRDYIISPVKNDRGEFFCSEFSEGTMPKDADANGAYNIARKGLWVLEQIRQKDEGEKVNLSMTNAEWLKYAQLHLL

SEQ ID NO: 26 - protein, 1264 aa, Moraxella caprae
MLFQDFTHLYPLSKTMRFELKPIGKTLEHIHAKNFLSQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAITYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGALYDELAKIPTLYNKVRDYLSQKPFSTEKYKLNFGNPTLLNGWDLNKEKDNFGIILQKDGCYYLALLDKAHKKVFDNAPNTGKNVYQKMIYKLLPGPNKMLPKVFFAKSNLDYYNPSAELLDKYAQGTHKKGNNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSKDNLANPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDEADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWKICSHGDKRYVYDKTANQNKGATKGINVNDELKSLFARHHINDKQPNLVMDICQNNDKEFHKSLIYLLKTLLALRYSNASSDEDFILSPVANDEGMFFNSALADDTQPQNADANGAYHIALKGLWVLEQIKNSDDLNKVKLAIDNQTWLNFAQNR

SEQ ID NO: 27 - protein, 1259 aa, Synergistes jonesii
MANSLKDFTNIYQLSKTLRFELKPIGKTEEHINRKLIIMHDEKRGEDYKSVTKLIDDYHRKFIHETLDPAHFDWNPLAEALIQSGSKNNKALPAEQKEMREKIISMFTSQAVYKKLFKKELFSELLPEMIKSELVSDLEKQAQLDAVKSFDKFSTYFTGFHENRKNIYSKKDTSTSIAFRIVHQNFPKFLANVRAYTLIKERAPEVIDKAQKELSGILGGKTLDDIFSIESFNNVLTQDKIDYYNQIIGGVSGKAGDKKLRGVNEFSNLYRQQHPEVASLRIKMVPLYKQILSDRTTLSFVPEALKDDEQAINAVDGLRSELERNDIFNRIKRLFGKNNLYSLDKIWIKNSSISAFSNELFKNWSFIEDALKEFKENEFNGARSAGKKAEKWLKSKYFSFADIDAAVKSYSEQVSADISSAPSASYFAKFTNLIETAAENGRKFSYFAAESKAFRGDDGKTEIIKAYLDSLNDILHCLKPFETEDISDIDTEFYSAFAEIYDSVKDVIPVYNAVRNYTTQKPFSTEKFKLNFENPALAKGWDKNKEQNNTAIILMKDGKYYLGVIDKNNKLRADDLADDGSAYGYMKMNYKFIPTPHMELPKVFLPKRAPKRYNPSREILLIKENKTFIKDKNFNRTDCHKLIDFFKDSINKHKDWRTFGFDFSDTDSYEDISDFYMEVQDQGYKLTFTRLSAEKIDKWVEEGRLFLFQIYNKDFADGAQGSPNLHTLYWKAIFSEENLKDVVLKLNGEAELFFRRKSIDKPAVHAKGSMKVNRRDIDGNPIDEGTYVEICGYANGKRDMASLNAGARGLIESGLVRITEVKHELVKDKRYTIDKYFFHVPFTINFKAQGQGNINSDVNLFLRNNKDVNIIGIDRGERNLVYVSLIDRDGHIKLQKDFNIIGGMDYHAKLNQKEKERDTARKSWKTIGTIKELKEGYLSQVVHEIVRLAVDNNAVIVMEDLNIGFKRGRFKVEKQVYQKFEKMLIDKLNYLVFKDAGYDAPCGILKGLQLTEKFESFTKLGKQCGIIFYIPAGYTSKIDPTTGFVNLFNINDVSSKEKQKDFIGKLDSIRFDAKRDMFTFEFDYDKFRTYQTSYRKKWAVWTNGKRIVREKDKDGKFRMNDRLLTEDMKNILNKYALAYKAGEDILPDVISRDKSLASEIFYVFKNTLQMRNSKRDTGEDFIISPVLNAKGRFFDSRKTDAALPIDADANGAYHIALKGSLVLDAIDEKLKEDGRIDYKDMAVSNPKWFEFMQTRKFDF

SEQ ID NO: 28 - protein, 1264 aa, Prevotella brevis
MKQFTNLYQLSKTLRFELKPIGKTLEHINANGFIDNDAHRAESYKKVKKLIDDYHKDYIENVLNNFKLNGEYLQAYFDLYSQDTKDKQFKDIQDKLRKSIASALKGDDRYKTIDKKELIRQDMKTFLKKDTDKALLDEFYEFTTYFTGYHENRKNMYSDEAKSTAIAYRLIHDNLPKFIDNIAVFKKIANTSVADNFSTIYKNFEEYLNVNSIDEIFSLDYYNIVLTQTQIEVYNSIIGGRTLEDDTKIQGINEFVNLYNQQLANKKDRLPKLKPLFKQILSDRVQLSWLQEEFNTGADVLNAVKEYCTSYFDNVEESVKVLLTGISDYDLSKIYITNDLALTDVSQRMFGEWSIIPNAIEQRLRSDNPKKTNEKEEKYSDRISKLKKLPKSYSLGYINECISELNGIDIADYYATLGAINTESKQEPSIPTSIQVHYNALKPILDTDYPREKNLSQDKLTVMQLKDLLDDFKALQHFIKPLLGNGDEAEKDEKFYGELMQLWEVIDSITPLYNKVRNYCTRKPFSTEKIKVNFENAQLLDGWDENKESTNASIILRKNGMYYLGIMKKEYRNILTKPMPSDGDCYDKVVYKFFKDITTMVPKCTTQMKSVKEHFSNSNDDYTLFEKDKFIAPVVITKEIFDLNNVLYNGVKKFQIGYLNNTGDSFGYNHAVEIWKSFCLKFLKAYKSTSIYDFSSIEKNIGCYNDLNSFYGAVNLLLYNLTYRKVSVDYIHQLVDEDKMYLFMIYNKDFSTYSKGTPNMHTLYWKMLFDESNLNDVVYKLNGQAEVFYRKKSITYQHPTHPANKPIDNKNVNNPKKQSNFEYDLIKDKRYTVDKFMFHVPITLNFKGMGNGDINMQVREYIKTTDDLHFIGIDRGERHLLYICVINGKGEIVEQYSLNEIVNNYKGTEYKTDYHTLLSERDKKRKEERSSWQTIEGIKELKSGYLSQVIHKITQLMIKYNAIVLLEDLNMGFKRGRQKVESSVYQQFEKALIDKLNYLVDKNKDANEIGGLLHAYQLTNDPKLPNKNSKQSGFLFYVPAWNTSKIDPVTGFVNLLDTRYENVAKAQAFFKKFDSIRYNKEYDRFEFKFDYSNFTAKAEDTRTQWTLCTYGTRIETFRNAEKNSNWDSREIDLTTEWKTLFTQHNIPLNANLKEAILLQANKNFYTDILHLMKLTLQMRNSVTGTDIDYMVSPVANECGEFFDSRKVKEGLPVNADANGAYNIARKGLWLAQQIKNANDLSDVKLAITNKEWLQFAQKKQYLKD

SEQ ID NO: 29 - protein, 1273 aa, Flavobacterium sp.
MKNFSNLYQVSKTVRFELKPIGNTLENIKNKSLLKNDSIRAESYQKMKKTIDEFHKYFIDLALNNKKLSYLNEYIALYTQSAEAKKEDKFKADFKKVQDNLRKEIVSSFTEGEAKAIFSVLDKKELITIELEKWKNENNLAVYLDESFKSFTTYFTGFHQNRKNMYSAEANSTAIAYRLIHENLPKFIENSKAFEKSSQIAELQPKIEKLYKEFEAYLNVNSISELFEIDYFNEVLTQKGITVYNNIIGGRTATEGKQKIQGLNEIINLYNQTKPKNERLPKLKQLYKQILSDRISLSFLPDAFTEGKQVLKAVFEFYKINLLSYKQDGVEESQNLLELIQQVVKNLGNQDVNKIYLKNDTSLTTIAQQLFGDFSVFSAALQYRYETVVNPKYTAEYQKANEAKQEKLDKEKIKFVKQDYFSIAFLQEVVADYVKTLDENLDWKQKYTPSCIADYFTTHFIAKKENEADKTFNFIANIKAKYQCIQGILEQADDYEDELKQDQKLIDNIKFFLDAILEVVHFIKPLHLKSESITEKDNAFYDVFENYYEALNVVTPLYNMVRNYVTQKPYSTEKIKLNFENAQLLNGWDANKEKDYLTTILKRDGNYFLAIMDKKHNKTFQQFTEDDENYEKIVYKLLPGVNKMLPKVFFSNKNIAFFNPSKEILDNYKNNTHKKGATFNLKDCHALIDFFKDSLNKHEDWKYFDFQFSETKTYQDLSGFYKEVEHQGYKINFKKVSVSQIDTLIEEGKMYLFQIYNKDFSPYAKGKPNMHTLYWKALFETQNLENVIYKLNGQAEIFFRKASIKKKNIITHKAHQPIAAKNPLTPTAKNTFAYDLIKDKRYTVDKFQFHVPITMNFKATGNSYINQDVLAYLKDNPEVNIIGLDRGERHLVYLTLIDQKGTILLQESLNVIQDEKTHTPYHTLLDNKEIARDKARKNWGSIESIKELKEGYISQVVHKITKMMIEHNAIVVMEDLNFGFKRGRFKVEKQIYQKLEKMLIDKLNYLVLKDKQPHELGGLYNALQLTNKFESFQKMGKQSGFLFYVPAWNTSKIDPTTGFVNYFYTKYENVEKAKTFFSKFDSILYNKTKGYFEFVVKNYSDFNPKAADTRQEWTICTHGERIETKRQKEQNNNFVSTTIQLTEQFVNFFEKVGLDLSKELKTQLIAQNEKSFFEELFHLLKLTLQMRNSESHTEIDYLISPVANEKGIFYDSRKATASLPIDADANGAYHIAKKGLWIMEQINKTNSEDDLKKVKLAISNREWLQYVQQVQKK

SEQ ID NO: 30 - protein, 973 aa, Sneathia amnii
MTEEDTKSFVDEILLTPESVIKTIDNFIDSIIMNDIEGLKEEFLKISLENFEGIYISNKKLNEISNRKFGDYNSINMMIKQSMNEKGILSKKEINELIPDLENINKPKVKSFNLSFIFENLTKEHKELIIDYIRENICNVIENVKITIEKYRNIDNKIEFKNNAEKVSKIKEMLESINELCKLIKEFNTDEIEKNNEFYNILNKNFEIFESSYKVLNKVRNFVTKKEVIENKMKLNFSNYQLGNGWHKNKEKDCSIILFRKRNNERWIYYLGILKHGTKIKENDYLSSVDTGFYKMDYYAQNSLSKMIPKCSITVKNVKNAPEDESVILNDSKKFNEPLEITPEIRKLYGNNEHIKGDKFKKESLVKWIDFCKEFLLKYKSFEKAKKEILKLKESNLYENLEEFYSDAEEKAYFLEFINIDEDKIKKLVKEKNLYLFQIYNKDFSAYSTGNKNLHTMYFEELFTDENLKKPVFKLNGNTEVFYRIASSKPKIVHNKGEKLVNKTYLDDGIIKTIPDSVYEEISEKVKNNEDYSKLLEENNIKNLEIKVATHEIVKDKRYFENKFLFYLPITLNKKVSNKNTNKNINKNVIDEIKDCNEYNVIGIDRGERNLISLCIINQNGEIILQKEMNIIQSSDKYNVDYNEKLEIKSKERDNAKKNWSEIGKIKDLKSGYLSAVVHEIVKLAIEYNAVIILEDLNNGFKNSRKKVDKQIYQKFERALIEKLQFLIFKNYDKNEKGGLRNAFQLTPELKNITKVASQQGIIIYTNPAYTSKIDPTTGYANIIKKSNNNEESIVKAIDKISYDKEKDMFYFDINLSNSSFNLTVKNVLKKEWRIYTNGERIIYKDRKYITLNITQEMKDILSKCGIDYLNIDNLKQDILKNKLHKKVYYIFELANKMRNENKDVDYIISPVLNKDGKFFMTQEINELTPKDADLNGAYNIALKGKLMIDNLNKKEKFVFLSNEDWLNFIQGR

SEQ ID NO: 31 - protein, 1238 aa, Candidatus Methanoplasma
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 32 - protein, 1222 aa, Oribacterium sp.
METEILKYDFFEREGKYMYYDGLTKQYALSKTIRNELVPIGKTLDNIKKNRILEADIKRKSDYEHVKKLMDMYHKKIINEALDNFKLSVLEDAADIYFNKQNDERDIDAFLKIQDKLRKEIVEQLKGHTDYSKVGNKDFLGLLKAASTEEDRILIESFDNFYTYFTSYNKVRSNLYSAEDKSSTVAYRLINENLPKFFDNIKAYRTVRNAGVISGDMSIVEQDELFEVDTFNHTLTQYGIDTYNHMIGQLNSAINLYNQKMHGAGSFKKLPKMKELYKQLLTEREEEFIEEYTDDEVLITSVHNYVSYLIDYLNSDKVESFFDTLRKSDGKEVFIKNDVSKTTMSNILFDNWSTIDDLINHEYDSAPENVKKTKDDKYFEKRQKDLKKNKSYSLSKIAALCRDTTILEKYIRRLVDDIEKIYTSNNVFSDIVLSKHDRSKKLSKNTNAVQAIKNMLDSIKDFEHDVMLINGSGQEIKKNLNVYSEQEALAGILRQVDHIYNLTRNYLTKKPFSTEKIKLNFNRPTFLDGWDKNKEEANLGILLIKDNRYYLGIMNTSSNKAFVNPPKAISNDIYKKVDYKLLPGPNKMLPKVFFATKNIAYYAPSEELLSKYRKGTHKKGDSFSIDDCRNLIDFFKSSINKNTDWSTFGFNFSDTNSYNDISDFYREVEKQGYKLSFTDIDACYIKDLVDNNELYLFQIYNKDFSPYSKGKLNLHTLYFKMLFDQRNLDNVVYKLNGEAEVFYRPASIESDEQIIHKSGQNIKNKNQKRSNCKKTSTFDYDIVKDRRYCKDKFMLHLPITVNFGTNESGKFNELVNNAIRADKDVNVIGIDRGERNLLYVVVVDPCGKIIEQISLNTIVDKEYDIETDYHQLLDEKEGSRDKARKDWNTIENIKELKEGYLSQVVNIIAKLVLKYDAIICLEDLNFGFKRGRQKVEKQVYQKFEKMLIDKMNYLVLDKSRKQESPQKPGGALNALQLTSAFKSFKELGKQTGIIYYVPAYLTSKIDPTTGFANLFYIKYESVDKARDFFSKFDFIRYNQMDNYFEFGFDYKSFTERASGCKSKWIACTNGERIVKYRNSDKNNSFDDKTVILTDEYRSLFDKYLQNYIDEDDLKDQILQIDSADFYKNLIKLFQLTLQMRNSSSDGKRDYIISPVKNYREEFFCSEFSDDTFPRDADANGAYNIARKGLWVIKQIRETKSGTKINLAMSNSEWLEYAQCNLL

SEQ ID NO: 33 - protein, 1326 aa, Prevotella disiens
MKVMENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLK

SEQ ID NO: 34 - protein, 998 aa, Arcobacter butzleri
MGLLEHLEGAIVEDMFSLDYFSLTLSQRYIDIYNTMIGGNTLADGTKVQGINENINIYRQKNNIDRKNLPTLKPLHKQLLSDRETLSWIPEAFKTKEEVVGAIEDFYKNNIISFKCCDNIVDITKQFIDIFSLNEDYELNKIFIKNDISITSISQDIFKDYRIIKEALWQKHINENPKAAKSKDLTGDKEKYFSRKNSFFSFEEIISSLKLMGRKIDLFSYFKDNVEYRAHSIETTFIKWQKNKNDKKTTKELLDNILNLQRVLKPLYLKAEVEKDILFYSIFDIYFESLNEIVKLYNKVRDFESKKPYSLEKFKLNFQNSTLLSGWDVNKEPDNTSILLKKDGLYYLGIMDKKHNRVFKNLESSKGGYEKIEYKLLSGPNKMLPKVFFSNKSIGYYNPSPALLEKYKSGVHKKGESFDLNFCHELIDFFKASIDKHEDWKNFNFKFSDTSEYADISGFYREVEQQGYKITFKNIDEEFINTLINEGKLYLFQIYNKDFSTFSKGTKNLHTLYWEMIFNEENLKNVVYKLNGEAEIFYRKKSIEYSEDKMKYGHHYEELKDKFNYPIIKDKRFTMDKFQFHVPITMNFKATGRSYINEEVNDFLRQNSKDVKIIGINRGERHLIYLTMINAKGEIIQQYSLNEIVNSYNNKNFTVNYNEKLSKKEGERAIARENWGVVENIKELKEGYLSHAIHTISNLIVENNAIVVLEDLNFEFKRERLKVEKSIYQKFEKMLIDKLNYLVDKKKDINENGGLLKALQLTNKFESFEKIGKQNGFLFFVNAWNITKICPVTGFVSLFDTRYQSVDKAREFFSKFDSIKYNEEKEHYEFVFDYSNFTDKAKDTKTKWTVCSYGTRIKTFRNSEKNNNWDNKTVSPTEDLSKLLKSCDRDIKEFIISQDKKEFFVELLEIFSLIVQMKNSIINSEIDYIISPVANENGEFFDSRFANSSLPKNADANAAYNTARKGLMLLEKIRDSEIGKKIDMKITNTEWLNFVQER

SEQ ID NO: 35 - protein, 1475 aa, Treponema endosymbiont
MTAFEELTNLYSVSKTLRFELKPAGKDGNTLSAEESAKLFKEILDQDRKIKDAYLALKPVMDTIHEKIINSSLGSDEARQIDFSAYYIEYNKKDNEYAVKKAEESLRAAIRSAFDKAANELAKNAGNDEKGKPIFKKKKGKDVGVEYLTQAGIIKYIENHIKTLVPQKVKEFIDKKNVINAKGKKITERTGHLAVFDSFFTYFGGYNTNRKNYYTEDKEKATAVATRIVHDNLPKFCDNCIQFSQDKIVTKRKSKETIPARKDEYLNAYQFLKDSEKTTQIKDAATNTMIEAYPVDERTFEIARFSECLTQAGIEEYNRIIGHYNSLINLYNQTRKGESDFRKLEQFKTLHKQIGCGEKKGWRDALKDNEDLKGKLKAISEAGQKYFTASLNPDDITFFSFIDWLKKNEDWDGVYWSKSAVDKVSGVYFANWHDIKDRLKGNKACVHLDKNKELQINDAVELSGLFAVINSGNSESADIHAQEHGLFDALNQENNEDLSKTLFKQSVLDEKASLIDEKLSASKNLINLICADMENLANAFCETSAEIMKITDFKNEANILSIKNWLDTAKSLIWRVKDFDIKESKRKGNAINAELSNMLTELLHADDARWFDWYDLVRNYLTKKPQDDAKANKLKLNFGYGKLLDGFVDSHTDESDASTQYGGYLFRKRTDAQEKSDFEYFLGISKNTKLFRCHLQSTVQNHDKSNFERLEYYQAKSTTYFDAKYSENKAKLVEIIESLIDDRAKTDSELTVIGNEIKKRDGKGEITPSALFDRVKKDKAFSRILNDDTLLKAVTQAIRDLQNSCDNFSERAPRLKEVQKRGYFGIVGFKQIVEDLQTVAKENKVFNFFNVSQPEFENAFISGGKRIYLFKISNKDLSYSETSQKDENGQQKRNFKGIENLHTHYFRALMREYKNCTNVDLGKGEIFFRAPVPEIKKEATHKVYDKMVNRRENETHIAIPEKVHNELLLFANEKIAVNNLSNETKLYLDQNKKIDESRVKIKDVKHDIIKDKRFTEAKYQLHLSILLNFTPTKEEVNAKINDTFTKSDDIQFLGIDRGEKHLIYYSLVDANGTIRAQDHFDVINKTDYLQKITEAAKIRREKQENWQQKGNISNLKDGYISLVVHEIIEKMKDENGSFKPMFIVLEDLNTGFKRSRQKFEQQVYQKFELALAKKLNYLVDKNAKDGELASVSRALQLTPLVMNYQDIENRKQVGIMLYTRANYTSVTDPATGWRKTVYLKPGSEESIKKQILGVFSEIGVDEKGDYFFQYSDTNTERTWRLWSSKNGKSLERYRGRRDKNTNAFTVEPYDVKATLNKLFVGFDKDMSLLKQLKDGKTLSKIDGRKETAWESLRFVIDLIQQIRNSGDTSKNQDDNFLLSPVRNAQGEHFDSRLYQNQETPKLPKDADANGAYNIARKGIIMYAHIRQWINDGGQRFEKSSDLDLFVSDNEWDLWLFDSKQWKEQLQKFASRKQKK

SEQ ID NO: 36 - protein, 1251 aa, Moraxella lacunata
MLFQDFTHLYPLSKTVRFELKPIGKTLEHIHAKNFLSQDETMADMYQKVKAILDDYHRDFITKMMSEVTLTKLPEFYEVYLALRKNPKDDTLQKQLTEIQTALREEVVKPIDSGGKYKAGYERLFGAKLFKDGKELGDLAKFVIAQEGESSPKLPQIAHFEKFSTYFTGFHDNRKNMYSSDDKHTAIAYRLIHENLPRFIDNLQILVTIKQKHSVLYDQIVNELNANGLDVSLASHLDGYHKLLTQEGITAYNRIIGEVNSYTNKHNQICHKSERIAKLRPLHKQILSDGMGVSFLPSKFADDSEMCQAVNEFYRHYAHVFAKVQSLFDRFDDYQKDGIYVEHKNLNELSKQAFGDFALLGRVLDGYYVDVVNPEFNDKFAKAKTDNAKEKLTKEKDKFIKGVHSLASLEQAIEHYIAGHDDESVQAGKLGQYFKHGLAGVDNPIQKIHNSHSTIKGFLERERPAGERTLPKIKSDKSLEMTQLRQLKELLDNALNVVHFAKLLTTKTTLDNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMVYKLLPGSNKMLPKVFFAKSNLDYYNPSAELLDKYAQGTHKKGDNFNLKDCHALIDFFKASINKHPEWQHFGFEFSLTSSYQDLSDFYREVEPQGYQVKFVDIDADYIDELVEQGQLYLFQIYNKDFSPKAHGKPNLHTLYFKALFSEDNLANPIYKLNGEAEIFYRKASLDMNETTIHRAGEVLENKNPDNPKERQFVYDIIKDKRYTQDKFMLHVPITMNFGVQGMTIKEFNKKVNQSIQQYDEVNVIGIDRGERHLLYLTVINSKGEILEQRSLNDIITTSANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADNEIGSYKNALQLTNNFTDLKSIGKQTGFLFYVPAWNTSKIDPVTGFVDLLKPRYENIAQSQAFFDKFDKICYNADKGYFEFHIDYAKFTDKAKNSRQIWTICSHGDKRYVYDKTANQNKGATIGINVNDELKSLFARYRINDKQPNLVMDICQNNDKEFHKSLTYLLKALLALRYSNASSDEDFILSPVANDKGVFFNSALADDTQPQNADANGAYHIALKGLWLLNELKNSDDLDKVKLAIDNQTWLNFAQNR

SEQ ID NO: 37 - protein, 399 aa, Francisella philomiragia
MFYLKQILSDTESKSFVIDKLEDDSDVVTTIQSFYEQIAAFKTLEEKSIKETLSLLFDDLKAQKLDLSKIYFKNDKSLTDLSQQVFDDYSLIGTSVLEYITQQVAPKNLDNPSKKEQELIAKKTEKAKYLSLETIRDALNEFNKHRDIDKQCRFEEIFASFADIPVLFDEIAQNKNNLAQISIKYQNQGKKDLLQTSAEVDVKAIKDLLDQTNNLLHKLKIFHITQSEDKANILDKDEHFYLVFDECYFELANIVPLYNKIRNYITQKPYSDEKFKLNFENSTLANGWDKNKEPDNTAILFIKDDKYYLGVMNKKNNKIFDDKAIKENKGEGYKKVVYKLLPGANKMLPKVFFSAKSINFYNPSEDILRIRNHSTHTKNGSPQKDMKNLSLILKIAENL

SEQ ID NO: 38 - protein, 485 aa, Francisella philomiragia
MVYKLNGEAELFYRKQSIPKKITHPAKQAIANKNKDNPKKESFFEYDLIKDKRFTEDKFFFHCPITMNFKSSGANKFNDEVNLLLKEKANDVHILSIDRGERHLAYYTLVDSKGNIIKQDTFNIIGNDRMKTNYHDKLAAIEKDRESARKDWKKINNIKEMKEGYLSQVVHEIAKLVIEYNAIVVFEDLNFGFKRGRFKVEKQVYQKLEKMLIEKLNYLVFKDNEFDKAGGVLRAYQLTAPFETFKKMGKQTGVIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSILNSILQMRNSKTGTELDYLISPVADVNGNFFDSRHAPKNMPQDADANGAYHIGLKGLMLLYRIKNNQDGKKLNLVIKNEEYFEFVQNRNKSSKI

SEQ ID NO: 39 - protein, 939 aa, Francisella philomiragia
MNLYSNLTNKYSLSKTLRFELIPQGETLENIKARGLILDDEKRAKDYKKAKQIIDKYHQFFIEEILSSVCISEDLLQNYSDVYFKLKKSDDDNLQKDFKSAKDTIKKHISRYINDSEKFKNLFNQNLIDAKKGQESDLILWLKQSKDNGIELFKANSDITDIDEALEIIKSFKGWTTYFKGFHENRKNVYSSDDIPTSIIYRIVDDNLPKFIENKAKYENLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTLEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKYRDIDKQCRFEEIFASFADIPVLFDEIAQNKNNLAQISIKYQNQGKKDLLQTSAEVDVKAIKDLLDQTNNLLHKLKIFHITQSEDKANILDKDEHFYLVFDECYFELANIVALYNKIRNYITQKPYSDEKFKLNFENSTLANGWDKNKEPDNTAILFIKDDKYYLGVMNKKNNKIFDDKAIKENKGEGYKKVVYKLLPGANKMLPKVFFSAKSINFYNPSEDILRIRNHSTHTKNGSPQKGYEKLEFNIEDCRKFIDFYKHSISRHPEWKDFGFRFSDTKKYNSIDEFYREVENQGYKLTFENISESYIDSLVDEGKLYLFQIYNKDFSVYSKGKPNLHTLYWKALFDERNLQDVVYKLNGEAELFYRKQSIPKKITHPAKEAIANKNKDNPKKESIFEYDLIKDKRFTEDKFFFHCPITINFKSSGANKFNDEINLLLKEKANDVHILSIDRGERHLAYYTLVDGKGNIICKN

SEQ ID NO: 40 - protein, 1261 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPKVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 41 - protein, 1282 aa, Eubacterium eligens
MNGNRSIVYREFVGVTPVAKTLRNELRPVGHTQEHIIQNGLIQEDELRQEKSTELKNIMDDYYREYIDKSLSGLTDLDFTLLFELMNSVQSSLSKDNKKALEKEHNKMREQICTHLQSDSDYKNMFNAKLFKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDEHISLIESEEKADEIKKRLDMYMNMYHWVKAFIVDEVLDRDEMFYSDIDDIYNILENIVPLYNRVRNYVTQKPYTSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKDFAENSTGKENLHTMYFKNIFSEENLKNIVIKLNGQAELFYRKASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDVRIDMEKMYEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 42 - protein, 1263 aa, Eubacterium rectale
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQAEKRKAIYKKFADDDRFKNMFSAKLISDILPEFVIHNNNYSASEKEEKTQVIKLFSRFATSFKDYFKNRANCFSADDISSSSCHRIVNDNAEIFFSNALVYRRIVKNLSNDDINKISGDMKDSLKEMSLDEIYSYEKYGEFITQEGISFYNDICGKVNSFMNLYCQKNKENKNLYKLRKLHKQILCIADTSYEVPYKFESDEEVYQSVNGFLDNISSKHIVERLRKIGDNYNGYNLDKIYIVSRFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCRDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKENDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPEKLKNVGHQCGCIFYVPAAYTSKIDPTTGFANIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 43 - protein, 966 aa, Unknown
  Uncultured Bacterium
MENYDKCLTQLGIEKFNLEIVGEINKELNLFSQQNRDILPKAPKLKFLYKQIGCGKRIFDLFSIIVGNEWKELKNLQNNKDDGKSFSQKELLEKIRKLYKLFFDKPSDYELDKIYFNKQSINTISSMWFVNWHKLSELLSGKRIIKNKNKETGEYTIPKKISLADLKNILESETNVEDLFKKGKINEDEIKENNSVGVYEKLFSSNGWETFLAIWEYEINESFKVLDNNVAKFELKKQTKFQNLDKKERVFFIKEFCDAFLAIERMVKYHKVDENNDTDDNFYETIDLYLQETELRKYYDAFRNYLTEKPFSENKIKLNFKSGTLLGGWSQTFETYGSLIFEKNGEYFLGIINGTKFSESELNKIYNINSDSIKAKRLLYNTQKIDNKNPPRWFIRSKKTTFSPMVREGLLDPESILELYDKKLYSKTENKNGYKEYLPRLLDYFKDGFLKHKDFVQFKENFKWLDNSEYDTVVDFYNHTADMCYKTSWEDINFTELENLTKDSRIYLFKIYNKDFAEKTSGIKNSHTILFLELLKSENNLKLKLLGGGEVFYREKSIEKEIDKERSFKTDKFEIIKNKRYSEEKYFLHFPIEIKGRKLKGSFNQFLNKEISKKESVNILGIDRGEKHLLYYSLVNNNGEIIKQGSFNKIKCGNKIVDYNELLSKRAKEMMEARQSWETIGKIKDLKEGYLSQVIHEIYKLVIENNAIVVLEDLNTEFKAKRTAKVEKSVYKKFELALVKKLNHLILKEKKANELGGSLNAYQLTPYIKPGDVDKFEKAKQWGIMFYVRPDYTSQTDPVTGWRKTIYISNSETIENIKKKWKDANIKIYFDSDKKCFKFLYDKWELCAYPNLERLYWNRSEKNAEGKFGNMKKYSLHKEFECIFEGVNKSKNISDQMFDKEDFNWKSFIFYWNLLNQIRNSDKSKDENESDFIQSPIWSEKINDFFDSRKKYQIDLPENGDANGAY

SEQ ID NO: 44 - protein, 1247 aa, Unknown
  Uncultured Bacterium
MFKGDAFTGLYEVQKTLRFELVPIGLTQSYLENDWVIQKDKEVEENYGKIKAYFDLIHKEFVRQSLENAWLCQLDDFYEKYIELHNSLETRKDKNLAKQFEKVMKSLKKEFVSFFDAKWNEWKQKFSFLKKWWIDVLNEKEVLDLMAEFYPDEKELFDKFDKFFTYFSNFKESRKNFYADDGRAWAIATRAIDENLITFIKNIEDFKKLNSSFREFVNDNFSEEDKQIFEIDFYNNCLLQPWIDKYNKIVWWYSLENWEKVQWLNEKINNFKQNQNKSNSKDLKFPRMKLLYKQILGDKEKKVYIDEIRDDKNLIDLIDNSKRRNQIKIDNANDIINDFINNNAKFELDKIYLTRQSINTISSKYFSSWDYIRWYFWTGELQEFVSFYDLKETFWKIEYETLENIFKDCYVKGINTESQNNIVFETQGIYENFLNIFKFEFNQNISQISLLEWELDKIQNEDIKKNEKQVEVIKNYFDSVMSVYKMTKYFSLEKWKKRVELDTDNNFYNDFNEYLEGFEIWKDYNLVRNYITKKQVNTDKIKLNFDNSQFLTWWDKDKENERLGIILRREWKYYLWILKKWNTLNFGDYLQKEWEIFYEKMNYKQLNNVYRQLPRLLFPLTKKLNELKWDELKKYLSKYIQNFWYNEEIAQIKIEFDIFQESKEKWEKFDIDKLRKLIEYYKKWVLALYSDLYDLEFIKYKNYDDLSIFYSDVEKKMYNLNFTKIDKSLIDGKVKSWELYLFQIYNKDFSESKKEWSTENIHTKYFKLLFNEKNLQNLVVKLSWWADIFFRDKTENLKFKKDKNGQEILDHRRFSQDKIMFHISITLNANCWDKYWFNQYVNEYMNKERDIKIIWIDRWEKHLAYYCVIDKSWKIFNNEIWTLNELNWVNYLEKLEKIESSRKDSRISWWEIENIKELKNGYISQVINKLTELIVKYNAIIVFEDLNIWFKRWRQKIEKQIYQKLELALAKKLNYLTQKDKKDDEILWNLKALQLVPKVNDYQDIWNYKQSWIMFYVRANYTSVTCPNCWLRKNLYISNSATKENQKKSLNSIAIKYNDWKFSFSYEIDDKSWKQKQSLNKKKFIVYSDIERFVYSPLEKLTKVIDVNKKLLELFRDFNLSLDINKQIQEKDLDSVFFKSLTHLFNLILQLRNSDSKDNKDYISCPSCYYHSNNWLQWFEFNWDANWAYNIARKGIILLDRIRKNQEKPDLYVSDIDWDNFVQSNQFPNTIIPIQNIEKQVPLNIKI

SEQ ID NO: 45 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEEYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKIYFRSGTSLTDVSRKVFGEWSIINRALDNYYATTYPIKPREKSEKYEERKEKWLKQDFNVSLIQTAIDEYDNETVKGKNSGKVIVDYFAKFCDDKETDLIQKVNEGYIAVKDLLNTPYPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKENLYYLGIMDKRHNRIFRNVPKADKKDSCYEKMVYKLLPGANKMLPKVFFSQSRIQEFTPSAKLLENYENETHKKGDNFNLNHCHQLIDFFKDSINKHEDWKNFDFRFSATSTYADLSGFYHEVEHQGYKISFQSIADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHVPITMNFKAEGIFNMNQRVNQFLKANPDINIIGIDRGERHLLYYTLINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLKQAKDFFEKFDSIRLNSKADYFEFAFDFKNFTGKADGGRTKWTVCTTNEDRYAWNRALNNNRGSQEKYDITAELKSLFDGKVDYKSGKDLKQQIASQELADFFRTLMKYLSVTLSLRHNNGEKGETEQDYILSPVADSMGKFFDSRKAGDDMPKNADANGAYHIALKGLWCLEQISKTDDLKKVKLAISNKEWLEFMQTLKG

SEQ ID NO: 46 - protein, 1477 aa, Candidatus Peregrinibacteria
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEDKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAIMKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTEIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDCWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKK

SEQ ID NO: 47 - protein, 1285 aa, Candidatus Roizmanbacteria
MKSFDSFTNLYSLSKTLKFEMRPVGNTQKMLDNAGVFEKDKLIQKKYGKTKPYFDRLHREFIEEALTGVELIGLDENFRTLVDWQKDKKNNVAMKAYENSLQRLRTEIGKIFNLKAEDWVKNKYPILGLKNKNTDILFEEAVFGILKARYGEEKDTFIEVEEIDKTGKSKINQISIFDSWKGFTGYFKKFFETRKNFYKNDGTSTAIATRIIDQNLKRFIDNLSIVESVRQKVDLAETEKSFSISLSQFFSIDFYNKCLLQDGIDYYNKIIGGETLKNGEKLIGLNELINQYRQNNKDQKIPFFKLLDKQILSEKILFLDEIKNDTELIEALSQFAKTAEEKTKIVKKLFADFVENNSKYDLAQIYISQEAFNTISNKWTSETETFAKYLFEAMKSGKLAKYEKKDNSYKFPDFIALSQMKSALLSISLEGHFWKEKYYKISKFQEKTNWEQFLAIFLYEFNSLFSDKINTKDGETKQVGYYLFAKDLHNLILSEQIDIPKDSKVTIKDFADSVLTIYQMAKYFAVEKKRAWLAEYELDSFYTQPDTGYLQFYDNAYEDIVQVYNKLRNYLTKKPYSEEKWKLNFENSTLANGWDKNKESDNSAVILQKGGKYYLGLITKGHNKIFDDRFQEKFIVGIEGGKYEKIVYKFFPDQAKMFPKVCFSAKGLEFFRPSEEILRIYNNAEFKKGETYSIDSMQKLIDFYKDCLTKYEGWACYTFRHLKPTEEYQNNIGEFFRDVAEDGYRIDFQGISDQYIHEKNEKGELHLFEIHNKDWNLDKARDGKSKTTQKNLHTLYFESLFSNDNVVQNFPIKLNGQAEIFYRPKTEKDKLESKKDKKGNKVIDHKRYSENKIFFHVPLTLNRTKNDSYRFNAQINNFLANNKDINIIGVDRGEKHLVYYSVITQASDILESGSLNELNGVNYAEKLGKKAENREQARRDWQDVQGIKDLKKGYISQVVRKLADLAIKHNAIIILEDLNMRFKQVRGGIEKSIYQQLEKALIDKLSFLVDKGEKNPEQAGHLLKAYQLSAPFETFQKMGKQTGIIFYTQASYTSKSDPVTGWRPHLYLKYFSAKKAKDDIAKFTKIEFVNDRFELTYDIKDFQQAKEYPNKTVWKVCSNVERFRWDKNLNQNKGGYTHYTNITENIQELFTKYGIDITKDLLTQISTIDEKQNTSFFRDFIFYFNLICQIRNTDDSEIAKKNGKDDFILSPVEPFFDSRKDNGNKLPENGDDNGAYNIARKGIVILNKISQYSEKNENCEKMKWGDLYVSNIDWDNFVTQANARH

SEQ ID NO: 48 - protein, 1403 aa, Candidatus Falkowbacteria
MLFFMSTDITNKPREKGVFDNFTNLYEFSKTLTFGLIPLKWDDNKKMIVEDEDFSVLRKYGVIEEDKRIAESIKIAKFYLNILHRELIGKVLGSLKFEKKNLENYDRLLGEIEKNNKNENISEDKKKEIRKNFKKELSIAQDILLKKVGEVFESNGSGILSSKNCLDELTKRFTRQEVDKLRRENKDIGVEYPDVAYREKDGKEETKSFFAMDVGYLDDFHKNRKQLYSVKGKKNSLGRRILDNFEIFCKNKKLYEKYKNLDIDFSEIERNFNLTLEKVFDFDNYNERLTQEGLDEYAKILGGESNKQERTANIHGLNQIINLYIQKKQSEQKAEQKETGKKKIKFNKKDYPTFTCLQKQILSQVFRKEIIIESDRDLIRELKFFVEESKEKVDKARGIIEFLLNHEENDIDLAMVYLPKSKINSFVYKVFKEPQDFLSVFQDGASNLDFVSFDKIKTHLENNKLTYKIFFKTLIKENHDFESFLILLQQEIDLLIDGGETVTLGGKKESITSLDEKKNRLKEKLGWFEGKVRENEKMKDEEEGEFCSTVLAYSQAVLNITKRAEIFWLNEKQDAKVGEDNKDMIFYKKFDEFADDGFAPFFYFDKFGNYLKRRSRNTTKEIKLHFGNDDLLEGWDMNKEPEYWSFILRDRNQYYLGIGKKDGEIFHKKLGNSVEAVKEAYELENEADFYEKIDYKQLNIDRFEGIAFPKKTKTEEAFRQVCKKRADEFLGGDTYEFKILLAIKKEYDDFKARRQKEKDWDSKFSKEKMSKLIEYYITCLGKRDDWKRFNLNFRQPKEYEDRSDFVRHIQRQAYWIDPRKVSKDYVDKKVAEGEMFLFKVHNKDFYDFERKSEDKKNHTANLFTQYLLELFSCENIKNIKSKDLIESIFELDGKAEIRFRPKTDDVKLKIYQKKGKDVTYADKRDGNKEKEVIQHRRFAKDALTLHLKIRLNFGKHVNLFDFNKLVNTELFAKVPVKILGMDRGENNLIYYCFLDEHGEIENGKCGSLNRVGEQIITLEDDKKVKEPVDYFQLLVDREGQRDWEQKNWQKMTRIKDLKKAYLGNVVSWISKEMLSGIKEGVVTIGVLEDLNSNFKRTRFFRERQVYQGFEKALVNKLGYLVDKKYDNYRNVYQFAPIVDSVEEMEKNKQIGTLVYVPASYTSKICPHPKCGWRERLYMKNSASKEKIVGLLKSDGIKISYDQKNDRFYFEYQWEQEHKSDGKKKKYSGVDKVFSNVSRMRWDVEQKKSIDFVDGTDGSITNKLKSLLKGKGIELDNINQQIVNQQKELGVEFFQSIIFYFNLIMQIRNYDKEKSGSEADYIQCPSCLFDSRKPEMNGKLSAITNGDANGAYNIARKGFMQLCRIRENPQEPMKLITNREWDEAVREWDIYSAAQKIPVLSEEN

SEQ ID NO: 49 - protein, 1352 aa, Parcubacteria sp.
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 50 - protein, 1298 aa, Thiomicrospira sp.
MTKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQE

SEQ ID NO: 51 - protein, 1242 aa, Bacteroidales bacterium
MKKFTNLYPVQKTLRFELIPQGNTSKHLCKIIQEDEQIAEDSQEVKKLLDRYHKEFIAIALSSFPTSPLAKEIIPKLKEFAQIRATGDAKQISTIQDELRELVVKGFKGEGEQERRYKILIGAKGNPNADELFNTELINFLKDPAEQALVKKFQKHTGYFLGFNENRKNMYSAKAQSTAIAYRLIHENLPRFLDNITTYEKVKTYLKEEIPQLEKELVRAGASLVSHVDSVFTIDFFLEVFTQSGIDQYNALIGKIVNQEQGEVKGLNERINLYNQQHKQEAKLPLFKPLYKQILSDREQLSWLAEAYNSDKDLLDSIQKYYQLLIDNQIFERIPRLMHTLEKAPLDKIWITYDTQLTSISNTLYGSWRVIGEALGRNAKSEKERKSSQKKALNYSLESINQAIAKMPSDEELPPIQKYFIALGSNPSKKDASSGTLVDKVRSSYKACQDILTNPDHTGKKLIQDKKQVDLLKQLLDDLLILQRFIKPLLYSNNENETHKDEVFYTELTDIMDLLNPIVGLYNKVRNYLTQKPYSTEKFKINFKSSSLLAGWDRNKEKDNLGVILKREDKYYLAIMDKAHNATFKNKSLPTQGECYEKMEYKLLPGANKMLPKVYITSKKGIESFHPSEELQKKYKLGTHKKGASFNLSDMRALIDYFKESLEKHEEHSQFGFHFSDTSTYEDISGFYREVEQQAYKITFRKVSVEYIDQLVNEGKLYLFQIYNKDFSPYSKGTPNLHTLYWKMLFDPANLQDIVYKLNGEAEVFFRKKSLQYDRPTHPKGQPINKKSLLNEGETSLFDYDLIKDRRFTVDKFQFHVPITMNFKATQGTKVNQMVQEEVKKSKGFHLIGIDRGERNLLYIVVINERGEIIEQCSLNKIVNTYQEKEHTVDYKALLEKRSQSRLEERKSWQTIENIKELKGGYLSQVVHKIAQLMIKYNAIAVLEDLNFGFIRTRKKFEFSVYQEFEKKLIDKLGYVVDKKAPIQQEGGLLQAYQLTAPFKSFREMGKQNGFLFYVPAWNTSAIDPRTGFVNLLDTRYESIAKTKELIKKLKDIRYNSQKDWFEIDLDYNAFGNRAKGSRSKWRLCSYGERIEHTRKQDSNGQEESDSMVVLTEAFKDVFTKYQIDYRENLKEQLLLQSDKAFFVDFLSLLRLTLQLRNSLSNSLIDYILSPVADENGEFFDSRKALSNEPQDADANGAYHIALKGLWVLDKIRKTEKVTPAKLALSNQEWLSFAQEKPFFNE

SEQ ID NO: 52 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 53 - protein, 1310 aa, Helcococcus kunzii
MFEKLSNIVSISKTIRFKLIPVGKTLENIEKLGKLEKDFERSDFYPILKNISDDYYRQYIKEKLSDLNLDWQKLYDAHELLDSSKKESQKNLEMIQAQYRKVLFNILSGELDKSGEKNSKDLIKNNKALYGKLFKKQFILEVLPDFVNNNDSYSEEDLEGLNLYSKFTTRLKNFWETRKNVFTDKDIVTAIPFRAVNENFGFYYDNIKIFNKNIEYLENKIPNLENELKEADILDDNRSVKDYFTPNGFNYVITQDGIDVYQAIRGGFTKENGEKVQGINEILNLTQQQLRRKPETKNVKLGVLTKLRKQILEYSESTSFLIDQIEDDNDLVDRINKFNVSFFESTEVSPSLFEQIERLYNALKSIKKEEVYIDARNTQKFSQMLFGQWDVIRRGYTVKITEGSKEEKKKYKEYLELDETSKAKRYLNIREIEELVNLVEGFEEVDVFSVLLEKFKMNNIERSEFEAPIYGSPIKLEAIKEYLEKHLEEYHKWKLLLIGNDDLDTDETFYPLLNEVISDYYIIPLYNLTRNYLTRKHSDKDKIKVNFDFPTLADGWSESKISDNRSIILRKGGYYYLGILIDNKLLINKKNKSKKIYEILIYNQIPEFSKSIPNYPFTKKVKEHFKNNVSDFQLIDGYVSPLIITKEIYDIKKEKKYKKDFYKDNNTNKNYLYTIYKWIEFCKQFLYKYKGPNKESYKEMYDFSTLKDTSLYVNLNDFYADVNSCAYRVLFNKIDENTIDNAVEDGKLLLFQIYNKDFSPESKGKKNLHTLYWLSMFSEENLRTRKLKLNGQAEIFYRKKLEKKPIIHKEGSILLNKIDKEGNTIPENIYHECYRYLNKKIGREDLSDEAIALFNKDVLKYKEARFDIIKDRRYSESQFFFHVPITFNWDIKTNKNVNQIVQGMIKDGEIKHIIGIDRGERHLLYYSVIDLEGNIVEQGSLNTLEQNRFDNSTVKVDYQNKLRTREEDRDRARKNWTNINKIKELKDGYLSHVVHKLSRLIIKYEAIVIMENLNQGFKRGRFKVERQVYQKFELALMNKLSALSFKEKYDERKNLEPSGILNPIQACYPVDAYQELQGQNGIVFYLPAAYTSVIDPVTGFTNLFRLKSINSSKYEEFIKKFKNIYFDNEEEDFKFIFNYKDFAKANLVILNNIKSKDWKISTRGERISYNSKKKEYFYVQPTEFLINKLKELNIDYENIDIIPLIDNLEEKAKRKILKALFDTFKYSVQLRNYDFENDYIISPTADDNGNYYNSNEIDIDKTNLPNNGDANGAFNIARKGLLLKDRIVNSNESKVDLKIKNEDWINFIIS

SEQ ID NO: 54 - protein, 1257 aa, Prevotella bryantii
MQINNLKIIYMKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPKVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 55 - protein, 1262 aa, Bacteroidetes oral
MRKFNEFVGLYPISKTLRFELKPIGKTLEHIQRNKLLEHDAVRADDYVKVKKIIDKYHKCLIDEALSGFTFDTEADGRSNNSLSEYYLYYNLKKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNIAAFEKVVSSPLAEKINALYEDFKEYLNVEEISRVFRLDYYDELLTQKQIDLYNAIVGGRTEEDNKIQIKGLNQYINEYNQQQTDRSNRLPKLKPLYKQILSDRESVSWLPPKFDSDKNLLIKIKECYDALSEKEKVFDKLESILKSLSTYDLSKIYISNDSQLSYISQKMFGRWDIISKAIREDCAKRNPQKSRESLEKFAERIDKKLKTIDSISIGDVDECLAQLGETYVKRVEDYFVAMGESEIDDEQTDTTSFKKNIEGAYESVKELLNNADNITDNNLMQDKGNVEKIKTLLDAIKDLQRFIKPLLGKGDEADKDGVFYGEFTSLWTKLDQVTPLYNMVRNYLTSKPYSTKKIKLNFENSTLMDGWDLNKEPDNTTVIFCKDGLYYLGIMGKKYNRVFVDREDLPHDGECYDKMEYKLLPGANKMLPKVFFSETGIQRFLPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESKFEYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKVFFDKFKSIRYNSDKDWFEFVVDDYTRFSPKAEGTRRDWTICTQGKRIQICRNHQRNNEWEGQEIDLTKAFKEHFEAYGVDISKDLREQINTQNKKEFFEELLRLLRLTLQMRNSMPSSDIDYLISPVANDTGCFFDSRKQAELKENAVLPMNADANGAYNIARKGLLAIRKMKQEENDSAKISLAISNKEWLKFAQTKPYLED

SEQ ID NO: 56 - protein, 1318 aa, Flavobacterium branchiophilum
MTNKFTNQYSLSKTLRFELIPQGKTLEFIQEKGLLSQDKQRAESYQEMKKTIDKFHKYFIDLALSNAKLTHLETYLELYNKSAETKKEQKFKDDLKKVQDNLRKEIVKSFSDGDAKSIFAILDKKELITVELEKWFENNEQKDIYFDEKFKTFTTYFTGFHQNRKNMYSVEPNSTAIAYRLIHENLPKFLENAKAFEKIKQVESLQVNFRELMGEFGDEGLIFVNELEEMFQINYYNDVLSQNGITIYNSIISGFTKNDIKYKGLNEYINNYNQTKDKKDRLPKLKQLYKQILSDRISLSFLPDAFTDGKQVLKAIFDFYKINLLSYTIEGQEESQNLLLLIRQTIENLSSFDTQKIYLKNDTHLTTISQQVFGDFSVFSTALNYWYETKVNPKFETEYSKANEKKREILDKAKAVFTKQDYFSIAFLQEVLSEYILTLDHTSDIVKKHSSNCIADYFKNHFVAKKENETDKTFDFIANITAKYQCIQGILENADQYEDELKQDQKLIDNLKFFLDAILELLHFIKPLHLKSESITEKDTAFYDVFENYYEALSLLTPLYNMVRNYVTQKPYSTEKIKLNFENAQLLNGWDANKEGDYLTTILKKDGNYFLAIMDKKHNKAFQKFPEGKENYEKMVYKLLPGVNKMLPKVFFSNKNIAYFNPSKELLENYKKETHKKGDTFNLEHCHTLIDFFKDSLNKHEDWKYFDFQFSETKSYQDLSGFYREVEHQGYKINFKNIDSEYIDGLVNEGKLFLFQIYSKDFSPFSKGKPNMHTLYWKALFEEQNLQNVIYKLNGQAEIFFRKASIKPKNIILHKKKIKIAKKHFIDKKTKTSEIVPVQTIKNLNMYYQGKISEKELTQDDLRYIDNFSIFNEKNKTIDIIKDKRFTVDKFQFHVPITMNFKATGGSYINQTVLEYLQNNPEVKIIGLDRGERHLVYLTLIDQQGNILKQESLNTITDSKISTPYHKLLDNKENERDLARKNWGTVENIKELKEGYISQVVHKIATLMLEENAIVVMEDLNFGFKRGRFKVEKQIYQKLEKMLIDKLNYLVLKDKQPQELGGLYNALQLTNKFESFQKMGKQSGFLFYVPAWNTSKIDPTTGFVNYFYTKYENVDKAKAFFEKFEAIRFNAEKKYFEFEVKKYSDFNPKAEGTQQAWTICTYGERIETKRQKDQNNKFVSTPINLTEKIEDFLGKNQIVYGDGNCIKSQIASKDDKAFFETLLYWFKMTLQMRNSETRTDIDYLISPVMNDNGTFYNSRDYEKLENPTLPKDADANGAYHIAKKGLMLLNKIDQADLTKKVDLSISNRDWLQFVQKNK

SEQ ID NO: 57 - protein, 1230 aa, Lachnospiraceae bacterium
MHENNGKIADNFIGIYPVSKTLRFELKPVGKTQEYIEKHGILDEDLKRAGDYKSVKKIIDAYHKYFIDEALNGIQLDGLKNYYELYEKKRDNNEEKEFQKIQMSLRKQIVKRFSEHPQYKYLFKKELIKNVLPEFTKDNAEEQTLVKSFQEFTTYFEGFHQNRKNMYSDEEKSTAIAYRVVHQNLPKYIDNMRIFSMILNTDIRSDLTELFNNLKTKMDITIVEEYFAIDGFNKVVNQKGIDVYNTILGAFSTDDNTKIKGLNEYINLYNQKNKAKLPKLKPLFKQILSDRDKISFIPEQFDSDTEVLEAVDMFYNRLLQFVIENEGQITISKLLTNFSAYDLNKIYVKNDTTISAISNDLFDDWSYISKAVRENYDSENVDKNKRAAAYEEKKEKALSKIKMYSIEELNFFVKKYSCNECHIEGYFERRILEILDKMRYAYESCKILHDKGLINNISLCQDRQAISELKDFLDSIKEVQWLLKPLMIGQEQADKEEAFYTELLRIWEELEPITLLYNKVRNYVTKKPYTLEKVKLNFYKSTLLDGWDKNKEKDNLGIILLKDGQYYLGIMNRRNNKIADDAPLAKTDNVYRKMEYKLLTKVSANLPRIFLKDKYNPSEEMLEKYEKGTHLKGENFCIDDCRELIDFFKKGIKQYEDWGQFDFKFSDTESYDDISAFYKEVEHQGYKITFRDIDETYIDSLVNEGKLYLFQIYNKDFSPYSKGTKNLHTLYWEMLFSQQNLQNIVYKLNGNAEIFYRKASINQKDVVVHKADLPIKNKDPQNSKKESMFDYDIIKDKRFTCDKYQFHVPITMNFKALGENHFNRKVNRLIHDAENMHIIGIDRGERNLIYLCMIDMKGNIVKQISLNEIISYDKNKLEHKRNYHQLLKTREDENKSARQSWQTIHTIKELKEGYLSQVIHVITDLMVEYNAIVVLEDLNFGFKQGRQKFERQVYQKFEKMLIDKLNYLVDKSKGMDEDGGLLHAYQLTDEFKSFKQLGKQSGFLYYIPAWNTSKLDPTTGFVNLFYTKYESVEKSKEFINNFTSILYNQEREYFEFLFDYSAFTSKAEGSRLKWTVCSKGERVETYRNPKKNNEWDTQKIDLTFELKKLFNDYSISLLDGDLREQMGKIDKADFYKKFMKLFALIVQMRNSDEREDKLISPVLNKYGAFFETGKNERMPLDADANGAYNIARKGLWIIEKIKNTDVEQLDKVKLTISNKEWLQYAQEHIL

SEQ ID NO: 58 - protein, 1246 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 59 - protein, 1259 aa, Synergistes jonesii; identical to SEQ ID NO: 27

SEQ ID NO: 60 - protein, 1263 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 61 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKVLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQERRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHAQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 62 - protein, 1253 aa, Prevotella albensis
MNIKNFTGLYPLSKTLRFELKPIGKTKENIEKNGILTKDEQRAKDYLIVKGFIDEYHKQFIKDRLWDFKLPLESEGEKNSLEEYQELYELTKRNDAQEADFTEIKDNLRSSITEQLTKSGSAYDRIFKKEFIREDLVNFLEDEKDKNIVKQFEDFTTYFTGFYENRKNMYSSEEKSTAIAYRLIHQNLPKFMDNMRSFAKIANSSVSEHFSDIYESWKEYLNVNSIEEIFQLDYFSETLTQPHIEVYNYIIGKKVLEDGTEIKGINEYVNLYNQQQKDKSKRLPFLVPLYKQILSDREKLSWIAEEFDSDKKMLSAITESYNHLHNVLMGNENESLRNLLLNIKDYNLEKINITNDLSLTEISQNLFGRYDVFTNGIKNKLRVLTPRKKKETDENFEDRINKIFKTQKSFSIAFLNKLPQPEMEDGKPRNIEDYFITQGAINTKSIQKEDIFAQIENAYEDAQVFLQIKDTDNKLSQNKTAVEKIKTLLDALKELQHFIKPLLGSGEENEKDELFYGSFLAIWDELDTITPLYNKVRNWLTRKPYSTEKIKLNFDNAQLLGGWDVNKEHDCAGILLRKNDSYYLGIINKKTNHIFDTDITPSDGECYDKIDYKLLPGANKMLPKVFFSKSRIKEFEPSEAIINCYKKGTHKKGKNFNLTDCHRLINFFKTSIEKHEDWSKFGFKFSDTETYEDISGFYREVEQQGYRLTSHPVSASYIHSLVKEGKLYLFQIWNKDFSQFSKGTPNLHTLYWKMLFDKRNLSDVVYKLNGQAEVFYRKSSIEHQNRIIHPAQHPITNKNELNKKHTSTFKYDIIKDRRYTVDKFQFHVPITINFKATGQNNINPIVQEVIRQNGITHIIGIDRGERHLLYLSLIDLKGNIIKQMTLNEIINEYKGVTYKTNYHNLLEKREKERTEARHSWSSIESIKELKDGYMSQVIHKITDMMVKYNAIVVLEDLNGGFMRGRQKVEKQVYQKFEKKLIDKLNYLVDKKLDANEVGGVLNAYQLTNKFESFKKIGKQSGFLFYIPAWNTSKIDPITGFVNLFNTRYESIKETKVFWSKFDIIRYNKEKNWFEFVFDYNTFTTKAEGTRTKWTLCTHGTRIQTFRNPEKNAQWDNKEINLTESFKALFEKYKIDITSNLKESIMQETEKKFFQELHNLLHLTLQMRNSVTGTDIDYLISPVADEDGNFYDSRINGKNFPENADANGAYNIARKGLMLIRQIKQADPQKKFKFETITNKDWLKFAQDKPYLKD

SEQ ID NO: 63 - protein, 1231 aa, Butyrivibrio fibrisolvens
MYYESLTKLYPIKKTIRNELVPIGKTLENIKKNNILEADEDRKIAYIRVKAIMDDYHKRLINEALSGFALIDLDKAANLYLSRSKSADDIESFSRFQDKLRKAIAKRLREHENFGKIGNKDIIPLLQKLSENEDDYNALESFKNFYTYFESYNDVRLNLYSDKEKSSTVAYRLINENLPRFLDNIRAYDAVQKAGITSEELSSEAQDGLFLVNTFNNVLIQDGINTYNEDIGKLNVAINLYNQKNASVQGFRKVPKMKVLYKQILSDREESFIDEFESDTELLDSLESHYANLAKYFGSNKVQLLFTALRESKGVNVYVKNDIAKTSFSNVVFGSWSRIDELINGEYDDNNNRKKDEKYYDKRQKELKKNKSYTIEKIITLSTEDVDVIGKYIEKLESDIDDIRFKGKNFYEAVLCGHDRSKKLSKNKGAVEAIKGYLDSVKDFERDLKLINGSGQELEKNLVVYGEQEAVLSELSGIDSLYNMTRNYLTKKPFSTEKIKLNFNKPTFLDGWDYGNEEAYLGFFMIKEGNYFLAVMDANWNKEFRNIPSVDKSDCYKKVIYKQISSPEKSIQNLMVIDGKTVKKNGRKEKEGIHSGENLILEELKNTYLPKKINDIRKRRSYLNGDTFSKKDLTEFIGYYKQRVIEYYNGYSFYFKSDDDYASFKEFQEDVGRQAYQISYVDVPVSFVDDLINSGKLYLFRVYNKDFSEYSKGRLNLHTLYFKMLFDERNLKNVVYKLNGQAEVFYRPSSIKKEELIVHRAGEEIKNKNPKRAAQKPTRRLDYDIVKDRRYSQDKFMLHTSIIMNFGAEENVSFNDIVNGVLRNEDKVNVIGIDRGERNLLYVVVIDPEGKILEQRSLNCITDSNLDIETDYHRLLDEKESDRKIARRDWTTIENIKELKAGYLSQVVHIVAELVLKYNAIICLEDLNFGFKRGRQKVEKQVYQKFEKMLIDKLNYLVMDKSREQLSPEKISGALNALQLTPDFKSFKVLGKQTGIIYYVPAYLTSKIDPMTGFANLFYVKYENVDKAKEFFSKFDSIKYNKDGKNWNTKGYFEFAFDYKKFTDRAYGRVSEWTVCTVGERIIKFKNKEKNNSYDDKVIDLTNSLKELFDSYKVTYESEVDLKDAILAIDDPAFYRDLTRRLQQTLQMRNSSCDGSRDYIISPVKNSKGEFFCSDNNDDTTPNDADANGAFNIARKGLWVLNEIRNSEEGSKINLAMSNAQWLEYAQDNTI

SEQ ID NO: 64 - protein, 1235 aa, Anaerovibrio sp.
MVAFIDEFVGQYPVSKTLRFEARPVPETKKWLESDQCSVLFNDQKRNEYYGVLKELLDDYYRAYIEDALTSFTLDKALLENAYDLYCNRDTNAFSSCCEKLRKDLVKAFGNLKDYLLGSDQLKDLVKLKAKVDAPAGKGKKKIEVDSRLINWLNNNAKYSAEDREKYIKAIESFEGFVTYLTNYKQARENMFSSEDKSTAIAFRVIDQNMVTYFGNIRIYEKIKAKYPELYSALKGFEKFFSPTAYSEILSQSKIDEYNYQCIGRPIDDADFKGVNSLINEYRQKNGIKARELPVMSMLYKQILSDRDNSFMSEVINRNEEAIECAKNGYKVSYALFNELLQLYKKIFTEDNYGNIYVKTQPLTELSQALFGDWSILRNALDNGKYDKDIINLAELEKYFSEYCKVLDADDAAKIQDKFNLKDYFIQKNALDATLPDLDKITQYKPHLDAMLQAIRKYKLFSMYNGRKKMDVPENGIDFSNEFNAIYDKLSEFSILYDRIRNFATKKPYSDEKMKLSFNMPTMLAGWDYNNETANGCFLFIKDGKYFLGVADSKSKNIFDFKKNPHLLDKYSSKDIYYKVKYKQVSGSAKMLPKVVFAGSNEKIFGHLISKRILEIREKKLYTAAAGDRKAVAEWIDFMKSAIAIHPEWNEYFKFKFKNTAEYDNANKFYEDIDKQTYSLEKVEIPTEYIDEMVSQHKLYLFQLYTKDFSDKKKKKGTDNLHTMYWHGVFSDENLKAVTEGTQPIIKLNGEAEMFMRNPSIEFQVTHEHNKPIANKNPLNTKKESVFNYDLIKDKRYTERKFYFHCPITLNFRADKPIKYNEKINRFVENNPDVCIIGIDRGERHLLYYTVINQTGDILEQGSLNKISGSYTNDKGEKVNKETDYHDLLDRKEKGKHVAQQAWETIENIKELKAGYLSQVVYKLTQLMLQYNAVIVLENLNVGFKRGRTKVEKQVYQKFEKAMIDKLNYLVFKDRGYEMNGSYAKGLQLTDKFESFDKIGKQTGCIYYVIPSYTSHIDPKTGFVNLLNAKLRYENITKAQDTIRKFDSISYNAKADYFEFAFDYRSFGVDMARNEWVVCTCGDLRWEYSAKTRETKAYSVTDRLKELFKAHGIDYVGGENLVSHITEVADKHFLSTLLFYLRLVLKMRYTVSGTENENDFILSPVEYAPGKFFDSREATSTEPMNADANGAYHIALKGLMTIRGIEDGKLHNYGKGGENAAWFKFMQNQEYKNNG

SEQ ID NO: 65 - DNA, 164 bp, Tobacco Mosaic Virus
tcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtca

SEQ ID NO: 66 - DNA, 163 bp, Tobacco Mosaic Virus
cagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtca

SEQ ID NO: 67 - DNA, 139 bp, Tobacco Mosaic Virus
cctagaactaagatggaggaatgagttttaaaaagaataatttaatcgatgatgattcggaggctactgtcgccgaatcggattcgttttaaatagatcttacagtatcactactccatctcagttcgtgttcttgtca

SEQ ID NO: 68 - DNA, 130 bp, Artificial Sequence
  Synthetic Subgenomic promoter, engineered to fold into a structure similar to that of the U1 wild type subgenomic promoter
ccatcgtatttctagcaatagaactggaaaattaaattaacggctcgatgatgattcggaggctactgtcgccgaatcggattcgttgccgttaatttgagagtccagttttagagctagaaatagcaag

SEQ ID NO: 69 - DNA, 4851 bp, Tobacco Mosaic Virus
atggcatacacacagacagctaccacatcagctttgctggacactgtccgaggaaacaactccttggtcaatgatctagcaaagcgtcgtctttacgacacagcggttgaagagtttaacgctcgtgaccgcaggcccaaggtgaacttttcaaaagtaataagcgaggagcagacgcttattgctacccgggcgtatccagaattccaaattacattttataacacgcaaaatgccgtgcattcgcttgcaggtggattgcgatctttagaactggaatatctgatgatgcaaattccctacggatcattgacttatgacataggcgggaattttgcatcgcatctgttcaagggacgagcatatgtacactgctgcatgcccaacctggacgttcgagacatcatgcggcacgaaggccagaaagacagtattgaactatacctttctaggctagagagaggggggaaaacagtccccaacttccaaaaggaagcatttgacagatacgcagaaattcctgaagacgctgtctgtcacaatactttccagacatgcgaacatcagccgatgcagcaatcaggcagagtgtatgccattgcgctacacagcatatatgacataccagccgatgagttcggggcggcactcttgaggaaaaatgtccatacgtgctatgccgctttccacttctccgagaacctgcttcttgaagattcatgcgtcaatttggacgaaatcaacgcgtgtttttcgcgcgatggagacaagttgaccttttcttttgcatcagagagtactcttaattactgtcatagttattctaatattcttaagtatgtgtgcaaaacttacttcccggcctctaatagagaggtttacatgaaggagtttttagtcaccagagttaatacctggttttgtaagttttctagaatagatacttttcttttgtacaaaggtgtggcccataaaagtgtagatagtgagcagttttatactgcaatggaagacgcatggcattacaaaaagactcttgcaatgtgcaacagcgagagaatcctccttgaggattcatcatcagtcaattactggtttcccaaaatgagggatatggtcatcgtaccattattcgacatttctttggagactagtaagaggacgcgcaaggaagtcttagtgtccaaggatttcgtgtttacagtgcttaaccacattcgaacataccaggcgaaagctcttacatacgcaaatgttttgtccttcgtcgaatcgattcgatcgagggtaatcattaacggtgtgacagcgaggtccgaatgggatgtggacaaatctttgttacaatccttgtccatgacgttttacctgcatactaagcttgccgttctaaaggatgacttactgattagcaagtttagtctcggttcgaaaacggtgtgccagcatgtgtgggatgagatttcgctggcgtttgggaacgcatttccctccgtgaaagagaggctcttgaacaggaaacttatcagagtggcaggcgacgcattagagatcagggtgcctgatctatatgtgaccttccacgacagattagtgactgagtacaaggcctctgtggacatgcctgcgcttgacattaggaagaagatggaagaaacggaagtgatgtacaatgcactttcagaattatcggtgttaagggagtctgacaaattcgatgttgatgttttttcccagatgtgccaatctttggaagttgacccaatgacggcagcgaaggttatagtcgcggtcatgagcaatgagagcggtctgactctcacatttgaacgacctactgaggcgaatgttgcgctagctttacaggatcaagagaaggcttcagaaggtgcattggtagttacctcaagagaagttgaagaaccgtccatgaagggttcgatggccagaggagagttacaattagctggtcttgctggagatcatccggaatcgtcctattctaagaacgaggagatagagtctttagagcagtttcatatggcgacggcagattcgttaattcgtaagcagatgagctcgattgtgtacacgggtccgattaaagttcagcaaatgaaaaactttatcgatagcctggtagcatcactatctgctgcggtgtcgaatctcgtcaagatcctcaaagatacagctgctattgaccttgaaacccgtcaaaagtttggagtcttggatgttgcatctaggaagtggttaatcaaaccaacggccaagagtcatgcatggggtgttgttgaaacccacgcgaggaagtatcatgtggcgcttttggaatatgatgagcagggtgtggtgacatgcgatgattggagaagagtagctgttagctctgagtctgttgtttattccgacatggcgaaactcagaactctgcgcagactgcttcgaaacggagaaccgcatgtcagtagcgcaaaggttgttcttgtggacggagttccgggctgtggaaaaaccaaagaaattctttccagggttaattttgatgaagatctaattttagtacctgggaagcaagccgcggaaatgatcagaagacgtgcgaattcctcagggattattgtggccacgaaggacaacgttaaaaccgttgattctttcatgatgaattttgggaaaagcacacgctgtcagttcaagaggttattcattgatgaagggttgatgttgcatactggttgtgttaattttcttgtggcgatgtcattgtgcgaaattgcatatgtttacggagacacacagcagattccatacatcaatagagtttcaggattcccgtaccccgcccattttgccaaattggaagttgacgaggtggagacacgcagaactactctccgttgtccagccgatgtcacacattatctgaacaggagatatgagggctttgtcatgagcacttcttcggttaaaaagtctgtttcgcaggagatggtcggcggagccgccgtgatcaatccgatctcaaaacccttgcatggcaagatcttgacttttacccaatcggataaagaagctctgctttcaagagggtattcagatgttcacactgtgcatgaagtgcaaggcgagacatactctgatgtttcactagttaggttaacccctacaccggtctccatcattgcaggagacagcccacatgttttggtcgcattgtcaaggcacacctgttcgctcaagtactacactgttgttatggatcctttagttagtatcattagagatctagagaaacttagctcgtacttgttagatatgtataaggtcgatgcaggaacacaatagcaattacagattgactcggtgttcaaaggttccaatctttttgttgcagcgccaaagactggtgatatttctgatatgcagttttactatgataagtgtctcccaggcaacagcaccatgatgaataattttgatgctgttaccatgaggttgactgacatttcattgaatgtcaaagattgcatattggatatgtctaagtctgttgctgcgcctaaggatcaaatcaaaccactaatacctatggtacgaacggcggcagaaatgccacgccagactggactattggaaaatttagtggcgatgattaaaagaaactttaacgcacccgagttgtctggcatcattgatattgaaaatactgcatctttggttgtagataagttttttgatagttatttgcttaaagaaaaaagaaaaccaaataaaaatgtttctttgttcagtagagagtctctcaatagatggttagaaaagcaggaacaggtaacaataggccagctcgcagattttgattttgtggatttgccagcagttgatcagtacagacacatgattaaagcacaacccaaacaaaagttggacacttcaatccaaacggagtacccggctttgcagacgattgtgtaccattcaaaaaagatcaatgcaatattcggcccgttgtttagtgagcttactaggcaattactggacagtgttgattcgagcagatttttgtttttcacaagaaagacaccagcgcagattgaggatttcttcggagatctcgacagtcatgtgccgatggatgtcttggagctggatatatcaaaatacgacaaatctcagaatgaattccactgtgcagtagaatacgagatctggcgaagattgggtttcgaagacttcttgggagaagtttggaaacaagggcatagaaagaccaccctcaaggattataccgcaggtataaaaacttgcatctggtatcaaagaaagagcggggacgtcacgacgttcattggaaacactgtgatcattgctgcatgtttggcctcgatgcttccgatggagaaaataatcaaaggagccttttgcggtgacgatagtctgctgtactttccaaagggttgtgagtttccggatgtgcaacactccgcgaatcttatgtggaattttgaagcaaaactgtttaaaaaacagtatggatacttttgcggaagatatgtaatacatcacgacagaggatgcattgtgtattacgatcccctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatagatggctctagttgttaa

SEQ ID NO: 70 - DNA, 103 bp, Tobacco Mosaic Virus
gccgttaatttgagagtccagttttagagctagaaatagcaagttaaaataaggctagtccgttatcaacttgaaaaagtggcaccgagtcggtgcttttttt

SEQ ID NO: 71 - protein, 1616 aa, Tobacco Mosaic Virus
  misc_feature (1117)..(1117): Xaa can be any naturally occurring amino acid
MAYTQTATTSALLDTVRGNNSLVNDLAKRRLYDTAVEEFNARDRRPKVNFSKVISEEQTLIATRAYPEFQITFYNTQNAVHSLAGGLRSLELEYLMMQIPYGSLTYDIGGNFASHLFKGRAYVHCCMPNLDVRDIMRHEGQKDSIELYLSRLERGGKTVPNFQKEAFDRYAEIPEDAVCHNTFQTCEHQPMQQSGRVYAIALHSIYDIPADEFGAALLRKNVHTCYAAFHFSENLLLEDSCVNLDEINACFSRDGDKLTFSFASESTLNYCHSYSNILKYVCKTYFPASNREVYMKEFLVTRVNTWFCKFSRIDTFLLYKGVAHKSVDSEQFYTAMEDAWHYKKTLAMCNSERILLEDSSSVNYWFPKMRDMVIVPLFDISLETSKRTRKEVLVSKDFVFTVLNHIRTYQAKALTYANVLSFVESIRSRVIINGVTARSEWDVDKSLLQSLSMTFYLHTKLAVLKDDLLISKFSLGSKTVCQHVWDEISLAFGNAFPSVKERLLNRKLIRVAGDALEIRVPDLYVTFHDRLVTEYKASVDMPALDIRKKMEETEVMYNALSELSVLRESDKFDVDVFSQMCQSLEVDPMTAAKVIVAVMSNESGLTLTFERPTEANVALALQDQEKASEGALVVTSREVEEPSMKGSMARGELQLAGLAGDHPESSYSKNEEIESLEQFHMATADSLIRKQMSSIVYTGPIKVQQMKNFIDSLVASLSAAVSNLVKILKDTAAIDLETRQKFGVLDVASRKWLIKPTAKSHAWGVVETHARKYHVALLEYDEQGVVTCDDWRRVAVSSESVVYSDMAKLRTLRRLLRNGEPHVSSAKVVLVDGVPGCGKTKEILSRVNFDEDLILVPGKQAAEMIRRRANSSGIIVATKDNVKTVDSFMMNFGKSTRCQFKRLFIDEGLMLHTGCVNFLVAMSLCEIAYVYGDTQQIPYINRVSGFPYPAHFAKLEVDEVETRRTTLRCPADVTHYLNRRYEGFVMSTSSVKKSVSQEMVGGAAVINPISKPLHGKILTFTQSDKEALLSRGYSDVHTVHEVQGETYSDVSLVRLTPTPVSIIAGDSPHVLVALSRHTCSLKYYTVVMDPLVSIIRDLEKLSSYLLDMYKVDAGTQXQLQIDSVFKGSNLFVAAPKTGDISDMQFYYDKCLPGNSTMMNNFDAVTMRLTDISLNVKDCILDMSKSVAAPKDQIKPLIPMVRTAAEMPRQTGLLENLVAMIKRNFNAPELSGIIDIENTASLVVDKFFDSYLLKEKRKPNKNVSLFSRESLNRWLEKQEQVTIGQLADFDFVDLPAVDQYRHMIKAQPKQKLDTSIQTEYPALQTIVYHSKKINAIFGPLFSELTRQLLDSVDSSRFLFFTRKTPAQIEDFFGDLDSHVPMDVLELDISKYDKSQNEFHCAVEYEIWRRLGFEDFLGEVWKQGHRKTTLKDYTAGIKTCIWYQRKSGDVTTFIGNTVIIAACLASMLPMEKIIKGAFCGDDSLLYFPKGCEFPDVQHSANLMWNFEAKLFKKQYGYFCGRYVIHHDRGCIVYYDPLKLISKLGAKHIKDWEHLEEFRRSLCDVAVSLNNCAYYTQLDDAVWEVHKTAPPGSFVYKSLVKYLSDKVLFRSLFIDGSSC

SEQ ID NO: 72 - protein, 1616 aa, Tobacco Mosaic Virus
  misc_feature (1117)..(1117): Xaa can be any naturally occurring amino acid
MAYTQTATSSALLETVRGNNTLVNDLAKRRLYDTAVDEFNARDRRPKVNFSKVVSEEQTLIATKAYPEFQITFYNTQNAVHSLAGGLRSLELEYLMMQIPYGSLTYDIGGNFASHLFKGRAYVHCCMPNLDVRDIMRHEGQKDSIELYLSRLERGNKHVPNFQKEAFDRYAEMPNEVVCHDTFQTCRHSQECYTGRVYAIALHSIYDIPADEFGAALLRKNVHVCYAAFHFSENLLLEDSHVNLDEINACFQRDGDRLTFSFASESTLNYSHSYSNILKYVCKTYFPASNREVYMKEFLVTRVNTWFCKFSRIDTFLLYKGVAHKGVDSEQFYKAMEDAWHYKKTLAMCNSERILLEDSSSVNYWFPKMRDMVIVPLFDISLETSKKTRKEVLVSKDFVYTVLNHIRTYQAKALTYSNVLSFVESIRSRVIINGVTARSEWDVDKSLLQSLSMTFFLHTKLAVLKDDLLISKFALGPKTVSQHVWDEISLAFGNAFPSIKERLINRKLIKITENALEIRVPDLYVTFHDRLVSEYKMSVDMPVLDIRKKMEETEEMYNALSELSVLKNSDKFDVDVFSQMCQSLEVDPMTAAKVIVAVMSNESGLTLTFEQPTEANVALALQDSEKASDGALVVTSRDVEEPSIKGSMARGELQLAGLSGDVPESSYTRSEEIESLEQFHMATASSLIHKQMCSIVYTGPLKVQQMKNFIDSLVASLSAAVSNLVKILKDTAAIDLETRQKFGVLDVASKRWLVKPSAKNHAWGVVETHARKYHVALLEHDEFGIITCDNWRRVAVSSESVVYSDMAKLRTLRRLLKDGEPHVSSAKVVLVDGVPGCGKTKEILSRANFEEDLILVPGRQAAEMIRRRANASGIIVATKDNVRTVDSFLMNYGKGARCQSKRLFIDEGLMLHTGCVNFLVEMSLCDIAYVYGDTQQIPYINRVTGFPYPAHFAKLEVDEVETRRTTLRCPADVTHFLNQRYEGHVMCTSSEKKSVSQEMVSGAASINPVSKPLKGKILTFTQSDKEALVSRGYADVHTVHEVQGETYADVSLVRLTPTPVSIIARDSPHVLVSLSRHTKSLKYYTVVMDPLVSIIRDLERVSSYLLDMYKVDAGTQXQLQVDSVFKDFNLFVAAPKTGDISDMQFYYDKCLPGNSTLLNNYDAVTMKLTDISLNVKDCILDMSKSVAAPKDIKPTLIPMVRTAAEMPRQTGLLENLVAMIKRNFNSPELSGVVDIENTASLVVDKFFDSYLLKEKRKPNKNFSLFSRESLNRWIAKQEQVTIGQLADFDFVDLPAVDQYRHMIKAQPKQKLDLSIQTEYPALQTIVYHSKKINAIFGPLFSELTRQLLDSIDSSRFLFFTRKTPAQIEDFFGDLDSHVPMDVLELDVSKYDKSQNEFHCAVEYEIWRRLGLEDFLAEVWKQGHRKTTLKDYTAGIKTCLWYQRKSGDVTTFIGNTVIIASCLASMLPMEKLIKGAFCGDDSLLYFPKGCEYPDIQQAANLMWNFEAKLFKKQYGYFCGRYVIHHDRGCIVYYDPLKLISKLGAKHIKDWDHLEEFRRSLCDVAESLNNCAYYTQLDDAVGEVHKTAPPGSFVYKSLVKYLSDKVLFRSLFLDGSSC

SEQ ID NO: 73 - DNA, 807 bp, Tobacco Mosaic Virus
atggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcaggggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaa

SEQ ID NO: 74 - protein, 268 aa, Tobacco Mosaic Virus
MALVVKGKVNINEFIDLTKMEKILPSMFTPVKSVMCSKVDKIMVHENESLSGVNLLKGVKLIDSGYVCLAGLVVTGEWNLPDNCRGGVSVCLVDKRMERADEATLGSYYTAAAKKRFQFKVVPNYAITTQDAMKNVWQVLVNIRNVKMSAGFCPLSLEFVSVCIVYRNNIKLGLREKITNVRDGGPMELTEEVVDEFMEDVPMSIRLAKFRSRTGKKSDVRKGKNSSSDRSVPNKNYRNVKDFGGMSFKKNNLIDDDSEATVAESDSF

SEQ ID NO: 75 - DNA, 480 bp, Tobacco Mosaic Virus
atgccttatacaatcaactctccgagccaatttgtttacttaagttccgcttatgcagatcctgtgcagctgatcaatctgtgtacaaatgcattgggtaaccagtttcaaacgcaacaagctaggacaacagtccaacagcaatttgcggatgcctggaaacctgtgcctagtatgacagtgagatttcctgcatcggatttctatgtgtatagatataattcgacgcttgatccgttgatcacggcgttattaaatagcttcgatactagaaatagaataatagaggttgataatcaacccgcaccgaatactactgaaatcgttaacgcgactcagagggtagacgatgcgactgtagctataagggcttcaatcaataatttggctaatgaactggttcgtggaactggcatgttcaatcaagcaagctttgagactgctagtggacttgtctggaccacaactccggctacttag

SEQ ID NO: 76 - protein, 159 aa, Tobacco Mosaic Virus
MPYTINSPSQFVYLSSAYADPVQLINLCTNALGNQFQTQQARTTVQQQFADAWKPVPSMTVRFPASDFYVYRYNSTLDPLITALLNSFDTRNRIIEVDNQPAPNTTEIVNATQRVDDATVAIRASINNLANELVRGTGMFNQASFETASGLVWTTTPAT

SEQ ID NO: 77 - DNA, 4 bp, Artificial Sequence
  Protospacer Adjacent motif for Cpf1
  misc_feature (4)..(4): n is a, c, g, or t
tttn

SEQ ID NO: 78 - DNA, 7 bp, Artificial Sequence
  Protospacer Adjacent motif for Cas9 of S. thermophilus
  misc_feature (1)..(2): n is a, c, g, or t
nnagaaw

SEQ ID NO: 79 - DNA, 3 bp, Artificial Sequence
  Protospacer Adjacent motif for Cas9 of S. pyogenes
  misc_feature (1)..(1): n is a, c, g, or t
ngg

SEQ ID NO: 80 - DNA, 5 bp, Artificial Sequence
  Protospacer Adjacent motif for Cas9 of S. thermophilus
  misc_feature (1)..(1): n is a, c, g, or t
  misc_feature (4)..(4): n is a, c, g, or t
nggng

SEQ ID NO: 81 - DNA, 102 bp, Artificial Sequence
  Guide RNA Sequence
  misc_feature (1)..(20): n is a, c, g, or t
nnnnnnnnnnnnnnnnnnnngttttagagctagaaatagcaagttaaaataaggctagtccgttatcaacttgaaaaagtggcaccgagtcggtgctttttt

SEQ ID NO: 82 - DNA, 15784 bp, Artificial Sequence
  pJL 128 vector
gtatttttacaacaattaccaacaacaacaaacaacagacaacattacaattactatttacaattacaatggcatacacacagacagctaccacatcagctttgctggacactgtccgaggaaacaactccttggtcaatgatctagcaaagcgtcgtctttacgacacagcggttgaagagtttaacgctcgtgaccgcaggcccaaggtgaacttttcaaaagtaataagcgaggagcagacgcttattgctacccgggcgtatccagaattccaaattacattttataacacgcaaaatgccgtgcattcgcttgcaggtggattgcgatctttagaactggaatatctgatgatgcaaattccctacggatcattgacttatgacataggcgggaattttgcatcgcatctgttcaagggacgagcatatgtacactgctgcatgcccaacctggacgttcgagacatcatgcggcacgaaggccagaaagacagtattgaactatacctttctaggctagagagaggggggaaaacagtccccaacttccaaaaggaagcatttgacagatacgcagaaattcctgaagacgctgtctgtcacaatactttccagacatgcgaacatcagccgatgcagcaatcaggcagagtgtatgccattgcgctacacagcatatatgacataccagccgatgagttcggggcggcactcttgaggaaaaatgtccatacgtgctatgccgctttccacttctccgagaacctgcttcttgaagattcatgcgtcaatttggacgaaatcaacgcgtgtttttcgcgcgatggagacaagttgaccttttcttttgcatcagagagtactcttaattactgtcatagttattctaatattcttaagtatgtgtgcaaaacttacttcccggcctctaatagagaggtttacatgaaggagtttttagtcaccagagttaatacctggttttgtaagttttctagaatagatacttttcttttgtacaaaggtgtggcccataaaagtgtagatagtgagcagttttatactgcaatggaagacgcatggcattacaaaaagactcttgcaatgtgcaacagcgagagaatcctccttgaggattcatcatcagtcaattactggtttcccaaaatgagggatatggtcatcgtaccattattcgacatttctttggagactagtaagaggacgcgcaaggaagtcttagtgtccaaggatttcgtgtttacagtgcttaaccacattcgaacataccaggcgaaagctcttacatacgcaaatgttttgtccttcgtcgaatcgattcgatcgagggtaatcattaacggtgtgacagcgaggtccgaatgggatgtggacaaatctttgttacaatccttgtccatgacgttttacctgcatactaagcttgccgttctaaaggatgacttactgattagcaagtttagtctcggttcgaaaacggtgtgccagcatgtgtgggatgagatttcgctggcgtttgggaacgcatttccctccgtgaaagagaggctcttgaacaggaaacttatcagagtggcaggcgacgcattagagatcagggtgcctgatctatatgtgaccttccacgacagattagtgactgagtacaaggcctctgtggacatgcctgcgcttgacattaggaagaagatggaagaaacggaagtgatgtacaatgcactttcagaattatcggtgttaagggagtctgacaaattcgatgttgatgttttttcccagatgtgccaatctttggaagttgacccaatgacggcagcgaaggttatagtcgcggtcatgagcaatgagagcggtctgactctcacatttgaacgacctactgaggcgaatgttgcgctagctttacaggatcaagagaaggcttcagaaggtgcattggtagttacctcaagagaagttgaagaaccgtccatgaagggttcgatggccagaggagagttacaattagctggtcttgctggagatcatccggaatcgtcctattctaagaacgaggagatagagtctttagagcagtttcatatggcgacggcagattcgttaattcgtaagcagatgagctcgattgtgtacacgggtccgattaaagttcagcaaatgaaaaactttatcgatagcctggtagcatcactatctgctgcggtgtcgaatctcgtcaagatcctcaaagatacagctgctattgaccttgaaacccgtcaaaagtttggagtcttggatgttgcatctaggaagtggttaatcaaaccaacggccaagagtcatgcatggggtgttgttgaaacccacgcgaggaagtatcatgtggcgcttttggaatatgatgagcagggtgtggtgacatgcgatgattggagaagagtagctgttagctctgagtctgttgtttattccgacatggcgaaactcagaactctgcgcagactgcttcgaaacggagaaccgcatgtcagtagcgcaaaggttgttcttgtggacggagttccgggctgtggaaaaaccaaagaaattctttccagggttaattttgatgaagatctaattttagtacctgggaagcaagccgcggaaatgatcagaagacgtgcgaattcctcagggattattgtggccacgaaggacaacgttaaaaccgttgattctttcatgatgaattttgggaaaagcacacgctgtcagttcaagaggttattcattgatgaagggttgatgttgcatactggttgtgttaattttcttgtggcgatgtcattgtgcgaaattgcatatgtttacggagacacacagcagattccatacatcaatagagtttcaggattcccgtaccccgcccattttgccaaattggaagttgacgaggtggagacacgcagaactactctccgttgtccagccgatgtcacacattatctgaacaggagatatgagggctttgtcatgagcacttcttcggttaaaaagtctgtttcgcaggagatggtcggcggagccgccgtgatcaatccgatctcaaaacccttgcatggcaagatcttgacttttacccaatcggataaagaagctctgctttcaagagggtattcagatgttcacactgtgcatgaagtgcaaggcgagacatactctgatgtttcactagttaggttaacccctacaccggtctccatcattgcaggagacagcccacatgttttggtcgcattgtcaaggcacacctgttcgctcaagtactacactgttgttatggatcctttagttagtatcattagagatctagagaaacttagctcgtacttgttagatatgtataaggtcgatgcaggaacacaatagcaattacagattgactcggtgttcaaaggttccaatctttttgttgcagcgccaaagactggtgatatttctgatatgcagttttactatgataagtgtctcccaggcaacagcaccatgatgaataattttgatgctgttaccatgaggttgactgacatttcattgaatgtcaaagattgcatattggatatgtctaagtctgttgctgcgcctaaggatcaaatcaaaccactaatacctatggtacgaacggcggcagaaatgccacgccagactggactattggaaaatttagtggcgatgattaaaagaaactttaacgcacccgagttgtctggcatcattgatattgaaaatactgcatctttggttgtagataagttttttgatagttatttgcttaaagaaaaaagaaaaccaaataaaaatgtttctttgttcagtagagagtctctcaatagatggttagaaaagcaggaacaggtaacaataggccagctcgcagattttgattttgtggatttgccagcagttgatcagtacagacacatgattaaagcacaacccaaacaaaagttggacacttcaatccaaacggagtacccggctttgcagacgattgtgtaccattcaaaaaagatcaatgcaatattcggcccgttgtttagtgagcttactaggcaattactggacagtgttgattcgagcagatttttgtttttcacaagaaagacaccagcgcagattgaggatttcttcggagatctcgacagtcatgtgccgatggatgtcttggagctggatatatcaaaatacgacaaatctcagaatgaattccactgtgcagtagaatacgagatctggcgaagattgggtttcgaagacttcttgggagaagtttggaaacaagggcatagaaagaccaccctcaaggattataccgcaggtataaaaacttgcatctggtatcaaagaaagagcggggacgtcacgacgttcattggaaacactgtgatcattgctgcatgtttggcctcgatgcttccgatggagaaaataatcaaaggagccttttgcggtgacgatagtctgctgtactttccaaagggttgtgagtttccggatgtgcaacactccgcgaatcttatgtggaattttgaagcaaaactgtttaaaaaacagtatggatacttttgcggaagatatgtaatacatcacgacagaggatgcattgtgtattacgatcccctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatagatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcaggggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtcattaattaaccatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagggcacatcctagggcggccgctcgaggggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgggtcgaggtcggctgtgaaactcgaaaaggttccggaaaacaaaaaagagagtggtaggtaatagtgttaataataagaaaataaataatagtggtaagaaaggtttgaaagttgaggaaattgaggataatgtaagtgatgacgagtctatcgcgtcatcgagtacgttttaatcaatatgccttatacaatcaactctccgagccaatttgtttacttaagttccgcttatgcagatcctgtgcagctgatcaatctgtgtacaaatgcattgggtaaccagtttcaaacgcaacaagctaggacaacagtccaacagcaatttgcggatgcctggaaacctgtgcctagtatgacagtgagatttcctgcatcggatttctatgtgtatagatataattcgacgcttgatccgttgatcacggcgttattaaatagcttcgatactagaaatagaataatagaggttgataatcaacccgcaccgaatactactgaaatcgttaacgcgactcagagggtagacgatgcgactgtagctataagggcttcaatcaataatttggctaatgaactggttcgtggaactggcatgttcaatcaagcaagctttgagactgctagtggacttgtctggaccacaactccggctacttagctattgttgtgagatttcctaaaataaagtcactgaagacttaaaattcagggtggctgataccaaaatcagcagtggttgttcgtccacttaaatataacgattgtcatatctggatccaacagttaaaccatgtgatggtgtatactgtggtatggcgtaaaacaacggaaaagtcgctgaagacttaaaattcagggtggctgataccaaaatcagcagtggttgttcgtccacttaaaaataacgattgtcatatctggatccaacagttaaaccatgtgatggtgtatactgtggtatggcgtaaacaacggagaggttcgaatcctcccctaaccgcgggtagcggcccaggtacccggatgtgttttccgggctgatgagtccgtgaggacgaaaccctgcaggcatgcaagcttggcgtaatcatggtcatagcctagagtccgcaaatcaccagtctctctctacaaatctatctctctctattttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgacctgcagcccggccgggggatccactagcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacaggagatctcagtaaagcgctggctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaactcgagagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagctctagtggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggttttggtaccgggccccccctcgaggtcgacggtatcgataagcttgatatcgaattcctgcaggtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagagg

SEQ ID NO: 83 - DNA, 11670 bp, Artificial Sequence
  pJL 155 vector
gtatttttacaacaattaccaacaacaacaaacaacagacaacattacaattactatttacaattacaatggcatacacacagacagctaccacatcagctttgctggacactgtccgaggaaacaactccttggtcaatgatctagcaaagcgtcgtctttacgacacagcggttgaagagtttaacgctcgtgaccgcaggcccaaggtgaacttttcaaaagtaataagcgaggagcagacgcttattgctacccgggcgtatccagaattccaaattacattttataacacgcaaaatgccgtgcattcgcttgcaggtggattgcgatctttagaactggaatatctgatgatgcaaattccctacggatcattgacttatgacataggcgggaattttgcatcgcatctgttcaagggacgagcatatgtacactgctgcatgcccaacctggacgttcgagacatcatgcggcacgaaggccagaaagacagtattgaactatacctttctaggctagagagaggggggaaaacagtccccaacttccaaaaggaagcatttgacagatacgcagaaattcctgaagacgctgtctgtcacaatactttccagacatgcgaacatcagccgatgcagcaatcaggcagagtgtatgccattgcgctacacagcatatatgacataccagccgatgagttcggggcggcactcttgaggaaaaatgtccatacgtgctatgccgctttccacttctccgagaacctgcttcttgaagattcatgcgtcaatttggacgaaatcaacgcgtgtttttcgcgcgatggagacaagttgaccttttcttttgcatcagagagtactcttaattactgtcatagttattctaatattcttaagtatgtgtgcaaaacttacttcccggcctctaatagagaggtttacatgaaggagtttttagtcaccagagttaatacctggttttgtaagttttctagaatagatacttttcttttgtacaaaggtgtggcccataaaagtgtagatagtgagcagttttatactgcaatggaagacgcatggcattacaaaaagactcttgcaatgtgcaacagcgagagaatcctccttgaggattcatcatcagtcaattactggtttcccaaaatgagggatatggtcatcgtaccattattcgacatttctttggagactagtaagaggacgcgcaaggaagtcttagtgtccaaggatttcgtgtttacagtgcttaaccacattcgaacataccaggcgaaagctcttacatacgcaaatgttttgtccttcgtcgaatcgattcgatcgagggtaatcattaacggtgtgacagcgaggtccgaatgggatgtggacaaatctttgttacaatccttgtccatgacgttttacctgcatactaagcttgccgttctaaaggatgacttactgattagcaagtttagtctcggttcgaaaacggtgtgccagcatgtgtgggatgagatttcgctggcgtttgggaacgcatttccctccgtgaaagagaggctcttgaacaggaaacttatcagagtggcaggcgacgcattagagatcagggtgcctgatctatatgtgaccttccacgacagattagtgactgagtacaaggcctctgtggacatgcctgcgcttgacattaggaagaagatggaagaaacggaagtgatgtacaatgcactttcagaattatcggtgttaagggagtctgacaaattcgatgttgatgttttttcccagatgtgccaatctttggaagttgacccaatgacggcagcgaaggttatagtcgcggtcatgagcaatgagagcggtctgactctcacatttgaacgacctactgaggcgaatgttgcgctagctttacaggatcaagagaaggcttcagaaggtgcattggtagttacctcaagagaagttgaagaaccgtccatgaagggttcgatggccagaggagagttacaattagctggtcttgctggagatcatccggaatcgtcctattctaagaacgaggagatagagtctttagagcagtttcatatggcgacggcagattcgttaattcgtaagcagatgagctcgattgtgtacacgggtccgattaaagttcagcaaatgaaaaactttatcgatagcctggtagcatcactatctgctgcggtgtcgaatctcgtcaagatcctcaaagatacagctgctattgaccttgaaacccgtcaaaagtttggagtcttggatgttgcatctaggaagtggttaatcaaaccaacggccaagagtcatgcatggggtgttgttgaaacccacgcgaggaagtatcatgtggcgcttttggaatatgatgagcagggtgtggtgacatgcgatgattggagaagagtagctgttagctctgagtctgttgtttattccgacatggcgaaactcagaactctgcgcagactgcttcgaaacggagaaccgcatgtcagtagcgcaaaggttgttcttgtggacggagttccgggctgtggaaaaaccaaagaaattctttccagggttaattttgatgaagatctaattttagtacctgggaagcaagccgcggaaatgatcagaagacgtgcgaattcctcagggattattgtggccacgaaggacaacgttaaaaccgttgattctttcatgatgaattttgggaaaagcacacgctgtcagttcaagaggttattcattgatgaagggttgatgttgcatactggttgtgttaattttcttgtggcgatgtcattgtgcgaaattgcatatgtttacggagacacacagcagattccatacatcaatagagtttcaggattcccgtaccccgcccattttgccaaattggaagttgacgaggtggagacacgcagaactactctccgttgtccagccgatgtcacacattatctgaacaggagatatgagggctttgtcatgagcacttcttcggttaaaaagtctgtttcgcaggagatggtcggcggagccgccgtgatcaatccgatctcaaaacccttgcatggcaagatcttgacttttacccaatcggataaagaagctctgctttcaagagggtattcagatgttcacactgtgcatgaagtgcaaggcgagacatactctgatgtttcactagttaggttaacccctacaccggtctccatcattgcaggagacagcccacatgttttggtcgcattgtcaaggcacacctgttcgctcaagtactacactgttgttatggatcctttagttagtatcattagagatctagagaaacttagctcgtacttgttagatatgtataaggtcgatgcaggaacacaatagcaattacagattgactcggtgttcaaaggttccaatctttttgttgcagcgccaaagactggtgatatttctgatatgcagttttactatgataagtgtctcccaggcaacagcaccatgatgaataattttgatgctgttaccatgaggttgactgacatttcattgaatgtcaaagattgcatattggatatgtctaagtctgttgctgcgcctaaggatcaaatcaaaccactaatacctatggtacgaacggcggcagaaatgccacgccagactggactattggaaaatttagtggcgatgattaaaagaaactttaacgcacccgagttgtctggcatcattgatattgaaaatactgcatctttggttgtagataagttttttgatagttatttgcttaaagaaaaaagaaaaccaaataaaaatgtttctttgttcagtagagagtctctcaatagatggttagaaaagcaggaacaggtaacaataggccagctcgcagattttgattttgtggatttgccagcagttgatcagtacagacacatgattaaagcacaacccaaacaaaagttggacacttcaatccaaacggagtacccggctttgcagacgattgtgtaccattcaaaaaagatcaatgcaatattcggcccgttgtttagtgagcttactaggcaattactggacagtgttgattcgagcagatttttgtttttcacaagaaagacaccagcgcagattgaggatttcttcggagatctcgacagtcatgtgccgatggatgtcttggagctggatatatcaaaatacgacaaatctcagaatgaattccactgtgcagtagaatacgagatctggcgaagattgggtttcgaagacttcttgggagaagtttggaaacaagggcatagaaagaccaccctcaaggattataccgcaggtataaaaacttgcatctggtatcaaagaaagagcggggacgtcacgacgttcattggaaacactgtgatcattgctgcatgtttggcctcgatgcttccgatggagaaaataatcaaaggagccttttgcggtgacgatagtctgctgtactttccaaagggttgtgagtttccggatgtgcaacactccgcgaatcttatgtggaattttgaagcaaaactgtttaaaaaacagtatggatacttttgcggaagatatgtaatacatcacgacagaggatgcattgtgtattacgatcccctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatagatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcaggggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtcattaattaagccgttaatttgagagtccagttttagagctagaaatagcaagttaaaataaggctagtccgttatcaacttgaaaaagtggcaccgagtcggtgcctagggcggccgctcgaggggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgggtcgaggtcggctgtgaaactcgaaaaggttccggaaaacaaaaaagagagtggtaggtaatagtgttaataataagaaaataaataatagtggtaagaaaggtttgaaagttgaggaaattgaggataatgtaagtgatgacgagtctatcgcgtcatcgagtacgttttaatcaatatgccttatacaatcaactctccgagccaatttgtttacttaagttccgcttatgcagatcctgtgcagctgatcaatctgtgtacaaatgcattgggtaaccagtttcaaacgcaacaagctaggacaacagtccaacagcaatttgcggatgcctggaaacctgtgcctagtatgacagtgagatttcctgcatcggatttctatgtgtatagatataattcgacgcttgatccgttgatcacggcgttattaaatagcttcgatactagaaatagaataatagaggttgataatcaacccgcaccgaatactactgaaatcgttaacgcgactcagagggtagacgatgcgactgtagctataagggcttcaatcaataatttggctaatgaactggttcgtggaactggcatgttcaatcaagcaagctttgagactgctagtggacttgtctggaccacaactccggctacttagctattgttgtgagatttcctaaaataaagtcactgaagacttaaaattcagggtggctgataccaaaatcagcagtggttgttcgtccacttaaatataacgattgtcatatctggatccaacagttaaaccatgtgatggtgtatactgtggtatggcgtaaaacaacggaaaagtcgctgaagacttaaaattcagggtggctgataccaaaatcagcagtggttgttcgtccacttaaaaataacgattgtcatatctggatccaacagttaaaccatgtgatggtgtatactgtggtatggcgtaaacaacggagaggttcgaatcctcccctaaccgcgggtagcggcccaggtacccggatgtgttttccgggctgatgagtccgtgaggacgaaaccctgcaggcatgcaagcttggcgtaatcatggtcatagcctagagtccgcaaatcaccagtctctctctacaaatctatctctctctattttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgacctgcagcccggccgggggatccactagcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacaggagatctcagtaaagcgctggctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaactcgagagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagctctagtggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggttttggtaccgggccccccctcgaggtcgacggtatcgataagcttgatatcgaattcctgcaggtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagagg

SEQ ID NO: 84 - DNA, 15063 bp, Artificial Sequence
  pJL 165 vector
gtatttttacaacaattaccaacaacaacaaacaacagacaacattacaattactatttacaattacaatggcatacacacagacagctaccacatcagctttgctggacactgtccgaggaaacaactccttggtcaatgatctagcaaagcgtcgtctttacgacacagcggttgaagagtttaacgctcgtgaccgcaggcccaaggtgaacttttcaaaagtaataagcgaggagcagacgcttattgctacccgggcgtatccagaattccaaattacattttataacacgcaaaatgccgtgcattcgcttgcaggtggattgcgatctttagaactggaatatctgatgatgcaaattccctacggatcattgacttatgacataggcgggaattttgcatcgcatctgttcaagggacgagcatatgtacactgctgcatgcccaacctggacgttcgagacatcatgcggcacgaaggccagaaagacagtattgaactatacctttctaggctagagagaggggggaaaacagtccccaacttccaaaaggaagcatttgacagatacgcagaaattcctgaagacgctgtctgtcacaatactttccagacatgcgaacatcagccgatgcagcaatcaggcagagtgtatgccattgcgctacacagcatatatgacataccagccgatgagttcggggcggcactcttgaggaaaaatgtccatacgtgctatgccgctttccacttctccgagaacctgcttcttgaagattcatgcgtcaatttggacgaaatcaacgcgtgtttttcgcgcgatggagacaagttgaccttttcttttgcatcagagagtactcttaattactgtcatagttattctaatattcttaagtatgtgtgcaaaacttacttcccggcctctaatagagaggtttacatgaaggagtttttagtcaccagagttaatacctggttttgtaagttttctagaatagatacttttcttttgtacaaaggtgtggcccataaaagtgtagatagtgagcagttttatactgcaatggaagacgcatggcattacaaaaagactcttgcaatgtgcaacagcgagagaatcctccttgaggattcatcatcagtcaattactggtttcccaaaatgagggatatggtcatcgtaccattattcgacatttctttggagactagtaagaggacgcgcaaggaagtcttagtgtccaaggatttcgtgtttacagtgcttaaccacattcgaacataccaggcgaaagctcttacatacgcaaatgttttgtccttcgtcgaatcgattcgatcgagggtaatcattaacggtgtgacagcgaggtccgaatgggatgtggacaaatctttgttacaatccttgtccatgacgttttacctgcatactaagcttgccgttctaaaggatgacttactgattagcaagtttagtctcggttcgaaaacggtgtgccagcatgtgtgggatgagatttcgctggcgtttgggaacgcatttccctccgtgaaagagaggctcttgaacaggaaacttatcagagtggcaggcgacgcattagagatcagggtgcctgatctatatgtgaccttccacgacagattagtgactgagtacaaggcctctgtggacatgcctgcgcttgacattaggaagaagatggaagaaacggaagtgatgtacaatgcactttcagaattatcggtgttaagggagtctgacaaattcgatgttgatgttttttcccagatgtgccaatctttggaagttgacccaatgacggcagcgaaggttatagtcgcggtcatgagcaatgagagcggtctgactctcacatttgaacgacctactgaggcgaatgttgcgctagctttacaggatcaagagaaggcttcagaaggtgcattggtagttacctcaagagaagttgaagaaccgtccatgaagggttcgatggccagaggagagttacaattagctggtcttgctggagatcatccggaatcgtcctattctaagaacgaggagatagagtctttagagcagtttcatatggcgacggcagattcgttaattcgtaagcagatgagctcgattgtgtacacgggtccgattaaagttcagcaaatgaaaaactttatcgatagcctggtagcatcactatctgctgcggtgtcgaatctcgtcaagatcctcaaagatacagctgctattgaccttgaaacccgtcaaaagtttggagtcttggatgttgcatctaggaagtggttaatcaaaccaacggccaagagtcatgcatggggtgttgttgaaacccacgcgaggaagtatcatgtggcgcttttggaatatgatgagcagggtgtggtgacatgcgatgattggagaagagtagctgttagctctgagtctgttgtttattccgacatggcgaaactcagaactctgcgcagactgcttcgaaacggagaaccgcatgtcagtagcgcaaaggttgttcttgtggacggagttccgggctgtggaaaaaccaaagaaattctttccagggttaattttgatgaagatctaattttagtacctgggaagcaagccgcggaaatgatcagaagacgtgcgaattcctcagggattattgtggccacgaaggacaacgttaaaaccgttgattctttcatgatgaattttgggaaaagcacacgctgtcagttcaagaggttattcattgatgaagggttgatgttgcatactggttgtgttaattttcttgtggcgatgtcattgtgcgaaattgcatatgtttacggagacacacagcagattccatacatcaatagagtttcaggattcccgtaccccgcccattttgccaaattggaagttgacgaggtggagacacgcagaactactctccgttgtccagccgatgtcacacattatctgaacaggagatatgagggctttgtcatgagcacttcttcggttaaaaagtctgtttcgcaggagatggtcggcggagccgccgtgatcaatccgatctcaaaacccttgcatggcaagatcttgacttttacccaatcggataaagaagctctgctttcaagagggtattcagatgttcacactgtgcatgaagtgcaaggcgagacatactctgatgtttcactagttaggttaacccctacaccggtctccatcattgcaggagacagcccacatgttttggtcgcattgtcaaggcacacctgttcgctcaagtactacactgttgttatggatcctttagttagtatcattagagatctagagaaacttagctcgtacttgttagatatgtataaggtcgatgcaggaacacaatagcaattacagattgactcggtgttcaaaggttccaatctttttgttgcagcgccaaagactggtgatatttctgatatgcagttttactatgataagtgtctcccaggcaacagcaccatgatgaataattttgatgctgttaccatgaggttgactgacatttcattgaatgtcaaagattgcatattggatatgtctaagtctgttgctgcgcctaaggatcaaatcaaaccactaatacctatggtacgaacggcggcagaaatgccacgccagactggactattggaaaatttagtggcgatgattaaaagaaactttaacgcacccgagttgtctggcatcattgatattgaaaatactgcatctttggttgtagataagttttttgatagttatttgcttaaagaaaaaagaaaaccaaataaaaatgtttctttgttcagtagagagtctctcaatagatggttagaaaagcaggaacaggtaacaataggccagctcgcagattttgattttgtggatttgccagcagttgatcagtacagacacatgattaaagcacaacccaaacaaaagttggacacttcaatccaaacggagtacccggctttgcagacgattgtgtaccattcaaaaaagatcaatgcaatattcggcccgttgtttagtgagcttactaggcaattactggacagtgttgattcgagcagatttttgtttttcacaagaaagacaccagcgcagattgaggatttcttcggagatctcgacagtcatgtgccgatggatgtcttggagctggatatatcaaaatacgacaaatctcagaatgaattccactgtgcagtagaatacgagatctggcgaagattgggtttcgaagacttcttgggagaagtttggaaacaagggcatagaaagaccaccctcaaggattataccgcaggtataaaaacttgcatctggtatcaaagaaagagcggggacgtcacgacgttcattggaaacactgtgatcattgctgcatgtttggcctcgatgcttccgatggagaaaataatcaaaggagccttttgcggtgacgatagtctgctgtactttccaaagggttgtgagtttccggatgtgcaacactccgcgaatcttatgtggaattttgaagcaaaactgtttaaaaaacagtatggatacttttgcggaagatatgtaatacatcacgacagaggatgcattgtgtattacgatcccctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatagatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcaggggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtcattaattaaccatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagggcacatcctagaactaagatggaggaatgagttttaaaaagaataatttaatcgatgatgattcggaggctactgtcgccgaatcggattcgttttaaatagatcttacagtatcactactccatctcagttcgtgttcttgtcattaattaagccgttaatttgagagtccagttttagagctagaaatagcaagttaaaataaggctagtccgttatcaacttgaaaaagtggcaccgagtcggtgcctagggcggccgcggcggccgcggtcctgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggcccaggtacccggatgtgttttccgggctgatgagtccgtgaggacgaaaccctgcaggcatgcaagcttggcgtaatcatggtcatagcctagctagagtccgcaaatcaccagtctctctctacaaatctatctctctctattttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgacctgcagcccggccgggggatccactagcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacaggagatctcagtaaagcgctggctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaactcgagagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagctctagtggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggttttggtaccgggccccccctcgaggtcgacggtatcgataagcttgatatcgaattcctgcaggtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagagg

SEQ ID NO: 85 - DNA, 13107 bp, Artificial Sequence
  pJL 186 vector
gtatttttacaacaattaccaacaacaacaaacaacagacaacattacaattactatttacaattacaatggcatacacacagacagctaccacatcagctttgctggacactgtccgaggaaacaactccttggtcaatgatctagcaaagcgtcgtctttacgacacagcggttgaagagtttaacgctcgtgaccgcaggcccaaggtgaacttttcaaaagtaataagcgaggagcagacgcttattgctacccgggcgtatccagaattccaaattacattttataacacgcaaaatgccgtgcattcgcttgcaggtggattgcgatctttagaactggaatatctgatgatgcaaattccctacggatcattgacttatgacataggcgggaattttgcatcgcatctgttcaagggacgagcatatgtacactgctgcatgcccaacctggacgttcgagacatcatgcggcacgaaggccagaaagacagtattgaactatacctttctaggctagagagaggggggaaaacagtccccaacttccaaaaggaagcatttgacagatacgcagaaattcctgaagacgctgtctgtcacaatactttccagacatgcgaacatcagccgatgcagcaatcaggcagagtgtatgccattgcgctacacagcatatatgacataccagccgatgagttcggggcggcactcttgaggaaaaatgtccatacgtgctatgccgctttccacttctccgagaacctgcttcttgaagattcatgcgtcaatttggacgaaatcaacgcgtgtttttcgcgcgatggagacaagttgaccttttcttttgcatcagagagtactcttaattactgtcatagttattctaatattcttaagtatgtgtgcaaaacttacttcccggcctctaatagagaggtttacatgaaggagtttttagtcaccagagttaatacctggttttgtaagttttctagaatagatacttttcttttgtacaaaggtgtggcccataaaagtgtagatagtgagcagttttatactgcaatggaagacgcatggcattacaaaaagactcttgcaatgtgcaacagcgagagaatcctccttgaggattcatcatcagtcaattactggtttcccaaaatgagggatatggtcatcgtaccattattcgacatttctttggagactagtaagaggacgcgcaaggaagtcttagtgtccaaggatttcgtgtttacagtgcttaaccacattcgaacataccaggcgaaagctcttacatacgcaaatgttttgtccttcgtcgaatcgattcgatcgagggtaatcattaacggtgtgacagcgaggtccgaatgggatgtggacaaatctttgttacaatccttgtccatgacgttttacctgcatactaagcttgccgttctaaaggatgacttactgattagcaagtttagtctcggttcgaaaacggtgtgccagcatgtgtgggatgagatttcgctggcgtttgggaacgcatttccctccgtgaaagagaggctcttgaacaggaaacttatcagagtggcaggcgacgcattagagatcagggtgcctgatctatatgtgaccttccacgacagattagtgactgagtacaaggcctctgtggacatgcctgcgcttgacattaggaagaagatggaagaaacggaagtgatgtacaatgcactttcagaattatcggtgttaagggagtctgacaaattcgatgttgatgttttttcccagatgtgccaatctttggaagttgacccaatgacggcagcgaaggttatagtcgcggtcatgagcaatgagagcggtctgactctcacatttgaacgacctactgaggcgaatgttgcgctagctttacaggatcaagagaaggcttcagaaggtgcattggtagttacctcaagagaagttgaagaaccgtccatgaagggttcgatggccagaggagagttacaattagctggtcttgctggagatcatccggaatcgtcctattctaagaacgaggagatagagtctttagagcagtttcatatggcgacggcagattcgttaattcgtaagcagatgagctcgattgtgtacacgggtccgattaaagttcagcaaatgaaaaactttatcgatagcctggtagcatcactatctgctgcggtgtcgaatctcgtcaagatcctcaaagatacagctgctattgaccttgaaacccgtcaaaagtttggagtcttggatgttgcatctaggaagtggttaatcaaaccaacggccaagagtcatgcatggggtgttgttgaaacccacgcgaggaagtatcatgtggcgcttttggaatatgatgagcagggtgtggtgacatgcgatgattggagaagagtagctgttagctctgagtctgttgtttattccgacatggcgaaactcagaactctgcgcagactgcttcgaaacggagaaccgcatgtcagtagcgcaaaggttgttcttgtggacggagttccgggctgtggaaaaaccaaagaaattctttccagggttaattttgatgaagatctaattttagtacctgggaagcaagccgcggaaatgatcagaagacgtgcgaattcctcagggattattgtggccacgaaggacaacgttaaaaccgttgattctttcatgatgaattttgggaaaagcacacgctgtcagttcaagaggttattcattgatgaagggttgatgttgcatactggttgtgttaattttcttgtggcgatgtcattgtgcgaaattgcatatgtttacggagacacacagcagattccatacatcaatagagtttcaggattcccgtaccccgcccattttgccaaattggaagttgacgaggtggagacacgcagaactactctccgttgtccagccgatgtcacacattatctgaacaggagatatgagggctttgtcatgagcacttcttcggttaaaaagtctgtttcgcaggagatggtcggcggagccgccgtgatcaatccgatctcaaaacccttgcatggcaagatcttgacttttacccaatcggataaagaagctctgctttcaagagggtattcagatgttcacactgtgcatgaagtgcaaggcgagacatactctgatgtttcactagttaggttaacccctacaccggtctccatcattgcaggagacagcccacatgttttggtcgcattgtcaaggcacacctgttcgctcaagtactacactgttgttatggatcctttagttagtatcattagagatctagagaaacttagctcgtacttgttagatatgtataaggtcgatgcaggaacacaatagcaattacagattgactcggtgttcaaaggttccaatctttttgttgcagcgccaaagactggtgatatttctgatatgcagttttactatgataagtgtctcccaggcaacagcaccatgatgaataattttgatgctgttaccatgaggttgactgacatttcattgaatgtcaaagattgcatattggatatgtctaagtctgttgctgcgcctaaggatcaaatcaaaccactaatacctatggtacgaacggcggcagaaatgccacgccagactggactattggaaaatttagtggcgatgattaaaagaaactttaacgcacccgagttgtctggcatcattgatattgaaaatactgcatctttggttgtagataagttttttgatagttatttgcttaaagaaaaaagaaaaccaaataaaaatgtttctttgttcagtagagagtctctcaatagatggttagaaaagcaggaacaggtaacaataggccagctcgcagattttgattttgtggatttgccagcagttgatcagtacagacacatgattaaagcacaacccaaacaaaagttggacacttcaatccaaacggagtacccggctttgcagacgattgtgtaccattcaaaaaagatcaatgcaatattcggcccgttgtttagtgagcttactaggcaattactggacagtgttgattcgagcagatttttgtttttcacaagaaagacaccagcgcagattgaggatttcttcggagatctcgacagtcatgtgccgatggatgtcttggagctggatatatcaaaatacgacaaatctcagaatgaattccactgtgcagtagaatacgagatctggcgaagattgggtttcgaagacttcttgggagaagtttggaaacaagggcatagaaagaccaccctcaaggattataccgcaggtataaaaacttgcatctggtatcaaagaaagagcggggacgtcacgacgttcattggaaacactgtgatcattgctgcatgtttggcctcgatgcttccgatggagaaaataatcaaaggagccttttgcggtgacgatagtctgctgtactttccaaagggttgtgagtttccggatgtgcaacactccgcgaatcttatgtggaattttgaagcaaaactgtttaaaaaacagtatggatacttttgcggaagatatgtaatacatcacgacagaggatgcattgtgtattacgatcccctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatagatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcaggggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtcattaattaaccatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagggcacatcctagggccatcgtatttctagcaatagaactggaaaattaaattaacggctcgatgatgattcggaggctactgtcgccgaatcggattcgttgccgttaatttgagagtccagttttagagctagaaatagcaagttaaaataaggctagtccgttatcaacttgaaaaagtggcaccgagtcggtgccgcggtcctgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggcccaggtacccggatgtgttttccgggctgatgagtccgtgaggacgaaaccctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcaagcttaatacgactcactata

SEQ ID NO: 86 - DNA, 13171 bp, Artificial Sequence
  pJL 187 vector
gtatttttacaacaattaccaacaacaacaaacaacagacaacattacaattactatttacaattacaatggcatacacacagacagctaccacatcagctttgctggacactgtccgaggaaacaactccttggtcaatgatctagcaaagcgtcgtctttacgacacagcggttgaagagtttaacgctcgtgaccgcaggcccaaggtgaacttttcaaaagtaataagcgaggagcagacgcttattgctacccgggcgtatccagaattccaaattacattttataacacgcaaaatgccgtgcattcgcttgcaggtggattgcgatctttagaactggaatatctgatgatgcaaattccctacggatcattgacttatgacataggcgggaattttgcatcgcatctgttcaagggacgagcatatgtacactgctgcatgcccaacctggacgttcgagacatcatgcggcacgaaggccagaaagacagtattgaactatacctttctaggctagagagaggggggaaaacagtccccaacttccaaaaggaagcatttgacagatacgcagaaattcctgaagacgctgtctgtcacaatactttccagacatgcgaacatcagccgatgcagcaatcaggcagagtgtatgccattgcgctacacagcatatatgacataccagccgatgagttcggggcggcactcttgaggaaaaatgtccatacgtgctatgccgctttccacttctccgagaacctgcttcttgaagattcatgcgtcaatttggacgaaatcaacgcgtgtttttcgcgcgatggagacaagttgaccttttcttttgcatcagagagtactcttaattactgtcatagttattctaatattcttaagtatgtgtgcaaaacttacttcccggcctctaatagagaggtttacatgaaggagtttttagtcaccagagttaatacctggttttgtaagttttctagaatagatacttttcttttgtacaaaggtgtggcccataaaagtgtagatagtgagcagttttatactgcaatggaagacgcatggcattacaaaaagactcttgcaatgtgcaacagcgagagaatcctccttgaggattcatcatcagtcaattactggtttcccaaaatgagggatatggtcatcgtaccattattcgacatttctttggagactagtaagaggacgcgcaaggaagtcttagtgtccaaggatttcgtgtttacagtgcttaaccacattcgaacataccaggcgaaagctcttacatacgcaaatgttttgtccttcgtcgaatcgattcgatcgagggtaatcattaacggtgtgacagcgaggtccgaatgggatgtggacaaatctttgttacaatccttgtccatgacgttttacctgcatactaagcttgccgttctaaaggatgacttactgattagcaagtttagtctcggttcgaaaacggtgtgccagcatgtgtgggatgagatttcgctggcgtttgggaacgcatttccctccgtgaaagagaggctcttgaacaggaaacttatcagagtggcaggcgacgcattagagatcagggtgcctgatctatatgtgaccttccacgacagattagtgactgagtacaaggcctctgtggacatgcctgcgcttgacattaggaagaagatggaagaaacggaagtgatgtacaatgcactttcagaattatcggtgttaagggagtctgacaaattcgatgttgatgttttttcccagatgtgccaatctttggaagttgacccaatgacggcagcgaaggttatagtcgcggtcatgagcaatgagagcggtctgactctcacatttgaacgacctactgaggcgaatgttgcgctagctttacaggatcaagagaaggcttcagaaggtgcattggtagttacctcaagagaagttgaagaaccgtccatgaagggttcgatggccagaggagagttacaattagctggtcttgctggagatcatccggaatcgtcctattctaagaacgaggagatagagtctttagagcagtttcatatggcgacggcagattcgttaattcgtaagcagatgagctcgattgtgtacacgggtccgattaaagttcagcaaatgaaaaactttatcgatagcctggtagcatcactatctgctgcggtgtcgaatctcgtcaagatcctcaaagatacagctgctattgaccttgaaacccgtcaaaagtttggagtcttggatgttgcatctaggaagtggttaatcaaaccaacggccaagagtcatgcatggggtgttgttgaaacccacgcgaggaagtatcatgtggcgcttttggaatatgatgagcagggtgtggtgacatgcgatgattggagaagagtagctgttagctctgagtctgttgtttattccgacatggcgaaactcagaactctgcgcagactgcttcgaaacggagaaccgcatgtcagtagcgcaaaggttgttcttgtggacggagttccgggctgtggaaaaaccaaagaaattctttccagggttaattttgatgaagatctaattttagtacctgggaagcaagccgcggaaatgatcagaagacgtgcgaattcctcagggattattgtggccacgaaggacaacgttaaaaccgttgattctttcatgatgaattttgggaaaagcacacgctgtcagttcaagaggttattcattgatgaagggttgatgttgcatactggttgtgttaattttcttgtggcgatgtcattgtgcgaaattgcatatgtttacggagacacacagcagattccatacatcaatagagtttcaggattcccgtaccccgcccattttgccaaattggaagttgacgaggtggagacacgcagaactactctccgttgtccagccgatgtcacacattatctgaacaggagatatgagggctttgtcatgagcacttcttcggttaaaaagtctgtttcgcaggagatggtcggcggagccgccgtgatcaatccgatctcaaaacccttgcatggcaagatcttgacttttacccaatcggataaagaagctctgctttcaagagggtattcagatgttcacactgtgcatgaagtgcaaggcgagacatactctgatgtttcactagttaggttaacccctacaccggtctccatcattgcaggagacagcccacatgttttggtcgcattgtcaaggcacacctgttcgctcaagtactacactgttgttatggatcctttagttagtatcattagagatctagagaaacttagctcgtacttgttagatatgtataaggtcgatgcaggaacacaatagcaattacagattgactcggtgttcaaaggttccaatctttttgttgcagcgccaaagactggtgatatttctgatatgcagttttactatgataagtgtctcccaggcaacagcaccatgatgaataattttgatgctgttaccatgaggttgactgacatttcattgaatgtcaaagattgcatattggatatgtctaagtctgttgctgcgcctaaggatcaaatcaaaccactaatacctatggtacgaacggcggcagaaatgccacgccagactggactattggaaaatttagtggcgatgattaaaagaaactttaacgcacccgagttgtctggcatcattgatattgaaaatactgcatctttggttgtagataagttttttgatagttatttgcttaaagaaaaaagaaaaccaaataaaaatgtttctttgttcagtagagagtctctcaatagatggttagaaaagcaggaacaggtaacaataggccagctcgcagattttgattttgtggatttgccagcagttgatcagtacagacacatgattaaagcacaacccaaacaaaagttggacacttcaatccaaacggagtacccggctttgcagacgattgtgtaccattcaaaaaagatcaatgcaatattcggcccgttgtttagtgagcttactaggcaattactggacagtgttgattcgagcagatttttgtttttcacaagaaagacaccagcgcagattgaggatttcttcggagatctcgacagtcatgtgccgatggatgtcttggagctggatatatcaaaatacgacaaatctcagaatgaattccactgtgcagtagaatacgagatctggcgaagattgggtttcgaagacttcttgggagaagtttggaaacaagggcatagaaagaccaccctcaaggattataccgcaggtataaaaacttgcatctggtatcaaagaaagagcggggacgtcacgacgttcattggaaacactgtgatcattgctgcatgtttggcctcgatgcttccgatggagaaaataatcaaaggagccttttgcggtgacgatagtctgctgtactttccaaagggttgtgagtttccggatgtgcaacactccgcgaatcttatgtggaattttgaagcaaaactgtttaaaaaacagtatggatacttttgcggaagatatgtaatacatcacgacagaggatgcattgtgtattacgatcccctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatagatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcaggggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtcattaattaaccatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagggcacatcctagaactaagatggaggaatgagttttaaaaagaataatttaatcgatgatgattcggaggctactgtcgccgaatcggattcgttttaaatagatcttacagtatcactactccatctcagttcgtgttcttgtcattaattaagccgttaatttgagagtccagttttagagctagaaatagcaagttaaaataaggctagtccgttatcaacttgaaaaagtggcaccgagtcggtgcctaggggcggccgcggtcctgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggcccaggtacccggatgtgttttccgggctgatgagtccgtgaggacgaaaccctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcaagcttaatacgactcactata

SEQ ID NO: 87 - DNA, 5 bp, Unknown
  MlyI restriction enzyme recognition site
gagtc

SEQ ID NO: 88 - DNA, 8923 bp, Artificial Sequence
  pJL125 vector
agcttgatatcgaattcctgcaggtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacctcgagaattctcaacacaacatatacaaaacaaacgaatctcaagcaatcaagcattctacttctattgcagcaatttaaatcatttcttttaaagcaaaagcaattttctgaaaattttcaccatttacgaacgatagttaattaaccatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagggcacatcctagtatggcttctatgactggtggacaacagatgggcggcggccgctaatctagagtccgcaaatcaccagtctctctctacaaatctatctctctctattttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgacctgcagcccgggggatccactagcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacaggagatctcagtaaagcgctggctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaactcgagagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagctctagtggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggttttggtaccgggccccccctcgaggtcgacggtatcgata

SEQ ID NO: 89 - DNA, 4058 bp, Artificial Sequence
  pJL122 vector
tcggggagctgttggctggctggtggcaggatatattgtggtgtaaacaaattgacgcttagacaacttaataacacattgcggacgtttttaatgtactggggtggttttggtaccgggagtgatcaaaagtcccacatcgatcaggtgatatatagcagcttagtttatataatgatagagtcgacatagcgattgccgttaatttgagagtccagttttagagctagaaatagcaagttaaaataaggctagtccgttatcaacttgaaaaagtggcaccgagtcggtgctttttttgggtcggcatggcatctccacctcctcgcggtccgacctgggcatccgaaggaggacgtcgtccactcggatggctaagggagagctcgaatttccccgatcgttcaaacatttggcaataaagtttcttaagattgaatcctgttgccggtcttgcgactagagtccgcaaatcaccagtctctctctacaaatctatctctctctattttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgacctgcagcccggccgggggatccactagcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacaggagatctcagtaaagcgctggctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaactcgagagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagctctagtggactgatgggctgcctgtatcgagtggtgattttgtgccgagctgccgg

SEQ ID NO: 90 - DNA, 1366 bp, Artificial Sequence
  Predicted sequence of guide RNA expressed by pJL 155
gttttaaatagatcttacagtatcactactccatctcagttcgtgttcttgtcattaattaagccgttaatttgagagtccagttttagagctagaaatagcaagttaaaataaggctagtccgttatcaacttgaaaaagtggcaccgagtcggtgcctagggcggccgctcgaggggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgggtcgaggtcggctgtgaaactcgaaaaggttccggaaaacaaaaaagagagtggtaggtaatagtgttaataataagaaaataaataatagtggtaagaaaggtttgaaagttgaggaaattgaggataatgtaagtgatgacgagtctatcgcgtcatcgagtacgttttaatcaatatgccttatacaatcaactctccgagccaatttgtttacttaagttccgcttatgcagatcctgtgcagctgatcaatctgtgtacaaatgcattgggtaaccagtttcaaacgcaacaagctaggacaacagtccaacagcaatttgcggatgcctggaaacctgtgcctagtatgacagtgagatttcctgcatcggatttctatgtgtatagatataattcgacgcttgatccgttgatcacggcgttattaaatagcttcgatactagaaatagaataatagaggttgataatcaacccgcaccgaatactactgaaatcgttaacgcgactcagagggtagacgatgcgactgtagctataagggcttcaatcaataatttggctaatgaactggttcgtggaactggcatgttcaatcaagcaagctttgagactgctagtggacttgtctggaccacaactccggctacttagctattgttgtgagatttcctaaaataaagtcactgaagacttaaaattcagggtggctgataccaaaatcagcagtggttgttcgtccacttaaatataacgattgtcatatctggatccaacagttaaaccatgtgatggtgtatactgtggtatggcgtaaaacaacggaaaagtcgctgaagacttaaaattcagggtggctgataccaaaatcagcagtggttgttcgtccacttaaaaataacgattgtcatatctggatccaacagttaaaccatgtgatggtgtatactgtggtatggcgtaaacaacggagaggttcgaatcctcccctaaccgcgggtagcggccca

SEQ ID NO: 91 - DNA, 14991 bp, Artificial Sequence
  pJL 159 vector
gtatttttacaacaattaccaacaacaacaaacaacagacaacattacaattactatttacaattacaatggcatacacacagacagctaccacatcagctttgctggacactgtccgaggaaacaactccttggtcaatgatctagcaaagcgtcgtctttacgacacagcggttgaagagtttaacgctcgtgaccgcaggcccaaggtgaacttttcaaaagtaataagcgaggagcagacgcttattgctacccgggcgtatccagaattccaaattacattttataacacgcaaaatgccgtgcattcgcttgcaggtggattgcgatctttagaactggaatatctgatgatgcaaattccctacggatcattgacttatgacataggcgggaattttgcatcgcatctgttcaagggacgagcatatgtacactgctgcatgcccaacctggacgttcgagacatcatgcggcacgaaggccagaaagacagtattgaactatacctttctaggctagagagaggggggaaaacagtccccaacttccaaaaggaagcatttgacagatacgcagaaattcctgaagacgctgtctgtcacaatactttccagacatgcgaacatcagccgatgcagcaatcaggcagagtgtatgccattgcgctacacagcatatatgacataccagccgatgagttcggggcggcactcttgaggaaaaatgtccatacgtgctatgccgctttccacttctccgagaacctgcttcttgaagattcatgcgtcaatttggacgaaatcaacgcgtgtttttcgcgcgatggagacaagttgaccttttcttttgcatcagagagtactcttaattactgtcatagttattctaatattcttaagtatgtgtgcaaaacttacttcccggcctctaatagagaggtttacatgaaggagtttttagtcaccagagttaatacctggttttgtaagttttctagaatagatacttttcttttgtacaaaggtgtggcccataaaagtgtagatagtgagcagttttatactgcaatggaagacgcatggcattacaaaaagactcttgcaatgtgcaacagcgagagaatcctccttgaggattcatcatcagtcaattactggtttcccaaaatgagggatatggtcatcgtaccattattcgacatttctttggagactagtaagaggacgcgcaaggaagtcttagtgtccaaggatttcgtgtttacagtgcttaaccacattcgaacataccaggcgaaagctcttacatacgcaaatgttttgtccttcgtcgaatcgattcgatcgagggtaatcattaacggtgtgacagcgaggtccgaatgggatgtggacaaatctttgttacaatccttgtccatgacgttttacctgcatactaagcttgccgttctaaaggatgacttactgattagcaagtttagtctcggttcgaaaacggtgtgccagcatgtgtgggatgagatttcgctggcgtttgggaacgcatttccctccgtgaaagagaggctcttgaacaggaaacttatcagagtggcaggcgacgcattagagatcagggtgcctgatctatatgtgaccttccacgacagattagtgactgagtacaaggcctctgtggacatgcctgcgcttgacattaggaagaagatggaagaaacggaagtgatgtacaatgcactttcagaattatcggtgttaagggagtctgacaaattcgatgttgatgttttttcccagatgtgccaatctttggaagttgacccaatgacggcagcgaaggttatagtcgcggtcatgagcaatgagagcggtctgactctcacatttgaacgacctactgaggcgaatgttgcgctagctttacaggatcaagagaaggcttcagaaggtgcattggtagttacctcaagagaagttgaagaaccgtccatgaagggttcgatggccagaggagagttacaattagctggtcttgctggagatcatccggaatcgtcctattctaagaacgaggagatagagtctttagagcagtttcatatggcgacggcagattcgttaattcgtaagcagatgagctcgattgtgtacacgggtccgattaaagttcagcaaatgaaaaactttatcgatagcctggtagcatcactatctgctgcggtgtcgaatctcgtcaagatcctcaaagatacagctgctattgaccttgaaacccgtcaaaagtttggagtcttggatgttgcatctaggaagtggttaatcaaaccaacggccaagagtcatgcatggggtgttgttgaaacccacgcgaggaagtatcatgtggcgcttttggaatatgatgagcagggtgtggtgacatgcgatgattggagaagagtagctgttagctctgagtctgttgtttattccgacatggcgaaactcagaactctgcgcagactgcttcgaaacggagaaccgcatgtcagtagcgcaaaggttgttcttgtggacggagttccgggctgtggaaaaaccaaagaaattctttccagggttaattttgatgaagatctaattttagtacctgggaagcaagccgcggaaatgatcagaagacgtgcgaattcctcagggattattgtggccacgaaggacaacgttaaaaccgttgattctttcatgatgaattttgggaaaagcacacgctgtcagttcaagaggttattcattgatgaagggttgatgttgcatactggttgtgttaattttcttgtggcgatgtcattgtgcgaaattgcatatgtttacggagacacacagcagattccatacatcaatagagtttcaggattcccgtaccccgcccattttgccaaattggaagttgacgaggtggagacacgcagaactactctccgttgtccagccgatgtcacacattatctgaacaggagatatgagggctttgtcatgagcacttcttcggttaaaaagtctgtttcgcaggagatggtcggcggagccgccgtgatcaatccgatctcaaaacccttgcatggcaagatcttgacttttacccaatcggataaagaagctctgctttcaagagggtattcagatgttcacactgtgcatgaagtgcaaggcgagacatactctgatgtttcactagttaggttaacccctacaccggtctccatcattgcaggagacagcccacatgttttggtcgcattgtcaaggcacacctgttcgctcaagtactacactgttgttatggatcctttagttagtatcattagagatctagagaaacttagctcgtacttgttagatatgtataaggtcgatgcaggaacacaatagcaattacagattgactcggtgttcaaaggttccaatctttttgttgcagcgccaaagactggtgatatttctgatatgcagttttactatgataagtgtctcccaggcaacagcaccatgatgaataattttgatgctgttaccatgaggttgactgacatttcattgaatgtcaaagattgcatattggatatgtctaagtctgttgctgcgcctaaggatcaaatcaaaccactaatacctatggtacgaacggcggcagaaatgccacgccagactggactattggaaaatttagtggcgatgattaaaagaaactttaacgcacccgagttgtctggcatcattgatattgaaaatactgcatctttggttgtagataagttttttgatagttatttgcttaaagaaaaaagaaaaccaaataaaaatgtttctttgttcagtagagagtctctcaatagatggttagaaaagcaggaacaggtaacaataggccagctcgcagattttgattttgtggatttgccagcagttgatcagtacagacacatgattaaagcacaacccaaacaaaagttggacacttcaatccaaacggagtacccggctttgcagacgattgtgtaccattcaaaaaagatcaatgcaatattcggcccgttgtttagtgagcttactaggcaattactggacagtgttgattcgagcagatttttgtttttcacaagaaagacaccagcgcagattgaggatttcttcggagatctcgacagtcatgtgccgatggatgtcttggagctggatatatcaaaatacgacaaatctcagaatgaattccactgtgcagtagaatacgagatctggcgaagattgggtttcgaagacttcttgggagaagtttggaaacaagggcatagaaagaccaccctcaaggattataccgcaggtataaaaacttgcatctggtatcaaagaaagagcggggacgtcacgacgttcattggaaacactgtgatcattgctgcatgtttggcctcgatgcttccgatggagaaaataatcaaaggagccttttgcggtgacgatagtctgctgtactttccaaagggttgtgagtttccggatgtgcaacactccgcgaatcttatgtggaattttgaagcaaaactgtttaaaaaacagtatggatacttttgcggaagatatgtaatacatcacgacagaggatgcattgtgtattacgatcccctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatagatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcaggggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtcattaattaaccatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagggcacatcctagggccatcgtatttctagcaatagaactggaaaattaaattaacggctcgatgatgattcggaggctactgtcgccgaatcggattcgttgccgttaatttgagagtccagttttagagctagaaatagcaagttaaaataaggctagtccgttatcaacttgaaaaagtggcaccgagtcggtgccgcggtcctgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggcccaggtacccggatgtgttttccgggctgatgagtccgtgaggacgaaaccctgcaggcatgcaagcttggcgtaatcatggtcatagcctagctagagtccgcaaatcaccagtctctctctacaaatctatctctctctattttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgacctgcagcccggccgggggatccactagcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacaggagatctcagtaaagcgctggctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaactcgagagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagctctagtggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggttttggtaccgggccccccctcgaggtcgacggtatcgataagcttgatatcgaattcctgcaggtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagagg

SEQ ID NO: 92 - DNA, 15830 bp, Artificial Sequence
  pJL 164 vector
gtatttttacaacaattaccaacaacaacaaacaacagacaacattacaattactatttacaattacaatggcatacacacagacagctaccacatcagctttgctggacactgtccgaggaaacaactccttggtcaatgatctagcaaagcgtcgtctttacgacacagcggttgaagagtttaacgctcgtgaccgcaggcccaaggtgaacttttcaaaagtaataagcgaggagcagacgcttattgctacccgggcgtatccagaattccaaattacattttataacacgcaaaatgccgtgcattcgcttgcaggtggattgcgatctttagaactggaatatctgatgatgcaaattccctacggatcattgacttatgacataggcgggaattttgcatcgcatctgttcaagggacgagcatatgtacactgctgcatgcccaacctggacgttcgagacatcatgcggcacgaaggccagaaagacagtattgaactatacctttctaggctagagagaggggggaaaacagtccccaacttccaaaaggaagcatttgacagatacgcagaaattcctgaagacgctgtctgtcacaatactttccagacatgcgaacatcagccgatgcagcaatcaggcagagtgtatgccattgcgctacacagcatatatgacataccagccgatgagttcggggcggcactcttgaggaaaaatgtccatacgtgctatgccgctttccacttctccgagaacctgcttcttgaagattcatgcgtcaatttggacgaaatcaacgcgtgtttttcgcgcgatggagacaagttgaccttttcttttgcatcagagagtactcttaattactgtcatagttattctaatattcttaagtatgtgtgcaaaacttacttcccggcctctaatagagaggtttacatgaaggagtttttagtcaccagagttaatacctggttttgtaagttttctagaatagatacttttcttttgtacaaaggtgtggcccataaaagtgtagatagtgagcagttttatactgcaatggaagacgcatggcattacaaaaagactcttgcaatgtgcaacagcgagagaatcctccttgaggattcatcatcagtcaattactggtttcccaaaatgagggatatggtcatcgtaccattattcgacatttctttggagactagtaagaggacgcgcaaggaagtcttagtgtccaaggatttcgtgtttacagtgcttaaccacattcgaacataccaggcgaaagctcttacatacgcaaatgttttgtccttcgtcgaatcgattcgatcgagggtaatcattaacggtgtgacagcgaggtccgaatgggatgtggacaaatctttgttacaatccttgtccatgacgttttacctgcatactaagcttgccgttctaaaggatgacttactgattagcaagtttagtctcggttcgaaaacggtgtgccagcatgtgtgggatgagatttcgctggcgtttgggaacgcatttccctccgtgaaagagaggctcttgaacaggaaacttatcagagtggcaggcgacgcattagagatcagggtgcctgatctatatgtgaccttccacgacagattagtgactgagtacaaggcctctgtggacatgcctgcgcttgacattaggaagaagatggaagaaacggaagtgatgtacaatgcactttcagaattatcggtgttaagggagtctgacaaattcgatgttgatgttttttcccagatgtgccaatctttggaagttgacccaatgacggcagcgaaggttatagtcgcggtcatgagcaatgagagcggtctgactctcacatttgaacgacctactgaggcgaatgttgcgctagctttacaggatcaagagaaggcttcagaaggtgcattggtagttacctcaagagaagttgaagaaccgtccatgaagggttcgatggccagaggagagttacaattagctggtcttgctggagatcatccggaatcgtcctattctaagaacgaggagatagagtctttagagcagtttcatatggcgacggcagattcgttaattcgtaagcagatgagctcgattgtgtacacgggtccgattaaagttcagcaaatgaaaaactttatcgatagcctggtagcatcactatctgctgcggtgtcgaatctcgtcaagatcctcaaagatacagctgctattgaccttgaaacccgtcaaaagtttggagtcttggatgttgcatctaggaagtggttaatcaaaccaacggccaagagtcatgcatggggtgttgttgaaacccacgcgaggaagtatcatgtggcgcttttggaatatgatgagcagggtgtggtgacatgcgatgattggagaagagtagctgttagctctgagtctgttgtttattccgacatggcgaaactcagaactctgcgcagactgcttcgaaacggagaaccgcatgtcagtagcgcaaaggttgttcttgtggacggagttccgggctgtggaaaaaccaaagaaattctttccagggttaattttgatgaagatctaattttagtacctgggaagcaagccgcggaaatgatcagaagacgtgcgaattcctcagggattattgtggccacgaaggacaacgttaaaaccgttgattctttcatgatgaattttgggaaaagcacacgctgtcagttcaagaggttattcattgatgaagggttgatgttgcatactggttgtgttaattttcttgtggcgatgtcattgtgcgaaattgcatatgtttacggagacacacagcagattccatacatcaatagagtttcaggattcccgtaccccgcccattttgccaaattggaagttgacgaggtggagacacgcagaactactctccgttgtccagccgatgtcacacattatctgaacaggagatatgagggctttgtcatgagcacttcttcggttaaaaagtctgtttcgcaggagatggtcggcggagccgccgtgatcaatccgatctcaaaacccttgcatggcaagatcttgacttttacccaatcggataaagaagctctgctttcaagagggtattcagatgttcacactgtgcatgaagtgcaaggcgagacatactctgatgtttcactagttaggttaacccctacaccggtctccatcattgcaggagacagcccacatgttttggtcgcattgtcaaggcacacctgttcgctcaagtactacactgttgttatggatcctttagttagtatcattagagatctagagaaacttagctcgtacttgttagatatgtataaggtcgatgcaggaacacaatagcaattacagattgactcggtgttcaaaggttccaatctttttgttgcagcgccaaagactggtgatatttctgatatgcagttttactatgataagtgtctcccaggcaacagcaccatgatgaataattttgatgctgttaccatgaggttgactgacatttcattgaatgtcaaagattgcatattggatatgtctaagtctgttgctgcgcctaaggatcaaatcaaaccactaatacctatggtacgaacggcggcagaaatgccacgccagactggactattggaaaatttagtggcgatgattaaaagaaactttaacgcacccgagttgtctggcatcattgatattgaaaatactgcatctttggttgtagataagttttttgatagttatttgcttaaagaaaaaagaaaaccaaataaaaatgtttctttgttcagtagagagtctctcaatagatggttagaaaagcaggaacaggtaacaataggccagctcgcagattttgattttgtggatttgccagcagttgatcagtacagacacatgattaaagcacaacccaaacaaaagttggacacttcaatccaaacggagtacccggctttgcagacgattgtgtaccattcaaaaaagatcaatgcaatattcggcccgttgtttagtgagcttactaggcaattactggacagtgttgattcgagcagatttttgtttttcacaagaaagacaccagcgcagattgaggatttcttcggagatctcgacagtcatgtgccgatggatgtcttggagctggatatatcaaaatacgacaaatctcagaatgaattccactgtgcagtagaatacgagatctggcgaagattgggtttcgaagacttcttgggagaagtttggaaacaagggcatagaaagaccaccctcaaggattataccgcaggtataaaaacttgcatctggtatcaaagaaagagcggggacgtcacgacgttcattggaaacactgtgatcattgctgcatgtttggcctcgatgcttccgatggagaaaataatcaaaggagccttttgcggtgacgatagtctgctgtactttccaaagggttgtgagtttccggatgtgcaacactccgcgaatcttatgtggaattttgaagcaaaactgtttaaaaaacagtatggatacttttgcggaagatatgtaatacatcacgacagaggatgcattgtgtattacgatcccctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatagatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcaggggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtcattaattaaccatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagggcacatctgagggcaggggaagtctgctaacatgcggggacgtggaggaaaatcccggccccatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaacctagaactaagatggaggaatgagttttaaaaagaataatttaatcgatgatgattcggaggctactgtcgccgaatcggattcgttttaaatagatcttacagtatcactactccatctcagttcgtgttcttgtcattaattaagccgttaatttgagagtccagttttagagctagaaatagcaagttaaaataaggctagtccgttatcaacttgaaaaagtggcaccgagtcggtgcctagggcggccgcggcggccgcggtcctgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggcccaggtacccggatgtgttttccgggctgatgagtccgtgaggacgaaaccctgcaggcatgcaagcttggcgtaatcatggtcatagcctagctagagtccgcaaatcaccagtctctctctacaaatctatctctctctattttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgacctgcagcccggccgggggatccactagcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacaggagatctcagtaaagcgctggctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaactcgagagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagctctagtggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggttttggtaccgggccccccctcgaggtcgacggtatcgataagcttgatatcgaattcctgcaggtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagagg

SEQ ID NO: 93 - DNA, 399 bp, Artificial Sequence
  Predicted guide RNA produced from pJL 165
gttttaaatagatcttacagtatcactactccatctcagttcgtgttcttgtcattaattaagccgttaatttgagagtccagttttagagctagaaatagcaagttaaaataaggctagtccgttatcaacttgaaaaagtggcaccgagtcggtgcctagggcggccgcggcggccgcggtcctgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggccca

SEQ ID NO: 94 - DNA, 178 bp, Artificial Sequence
  Predicted guide RNA produced from pJL 159
ggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggccca

SEQ ID NO: 95 - DNA, 6 bp, Artificial Sequence
  Selected deletion from 775.seq
gagagt

SEQ ID NO: 96 - DNA, 8 bp, Artificial Sequence
  Selected deletion from 775.seq
ttgagagt

SEQ ID NO: 97 - DNA, 6 bp, Artificial Sequence
  Selected deletion from 284.seq
gagagt

SEQ ID NO: 98 - DNA, 8 bp, Artificial Sequence
  Selected deletion from 284.seq
ttgagagt

SEQ ID NO: 99 - DNA, 55 bp, Artificial Sequence
  Example of Cas9 triggered indel mutation recovered from transient expression of pJL 122 and pJL 125 T-DNAs in N. benthamiana cells
caaattggacttgtttcccgttaatttgagagtccaaggtaattcagcttatctt

SEQ ID NO: 100 - DNA, 54 bp, Artificial Sequence
  Example of Cas9 triggered indel mutation recovered from transient expression of pJL 122 and pJL 125 T-DNAs in N. benthamiana cells
caaattggacttgtttcccgttaatttgagatccaaggtaattcagcttatctt

SEQ ID NO: 101 - DNA, 49 bp, Artificial Sequence
  Example of Cas9 triggered indel mutation recovered from transient expression of pJL 122 and pJL 125 T-DNAs in N. benthamiana cells
caaattggacttgtttcccgttaatttccaaggtaattcagcttatctt

SEQ ID NO: 102 - DNA, 40 bp, Artificial Sequence
  Example of Cas9 triggered indel mutation recovered from transient expression of pJL 122 and pJL 125 T-DNAs in N. benthamiana cells
  misc_feature (30)..(30): n is a, c, g, or t
  misc_feature (34)..(34): n is a, c, g, or t
caaattggacttgtttcccgttaatttccnaggngattct

SEQ ID NO: 103 - DNA, 56 bp, Artificial Sequence
  Example of Cas9 triggered indel mutation recovered from transient expression of pJL 122 and pJL 125 T-DNAs in N. benthamiana cells
caaattggacttgtttcccgttaatttgagagttccaaggtaattcagcttatctt

SEQ ID NO: 104 - DNA, 52 bp, Artificial Sequence
  Example of Cas9 triggered indel mutation recovered from transient expression of pJL 122 and pJL 125 T-DNAs in N. benthamiana cells
caaattggacttgtttcccgttaatttgagccaaggtaattcagcttatctt

SEQ ID NO: 105 - DNA, 56 bp, Artificial Sequence; identical to SEQ ID NO: 103
  Example of Cas9 triggered indel mutation recovered from transient expression of pJL 122 and pJL 125 T-DNAs in N. benthamiana cells

SEQ ID NO: 106 - DNA, 47 bp, Artificial Sequence
  Sequence of indel mutation recovered from expression of Cas9 from TMV vector and sgRNA from pJL 122 in N. benthamiana cells
atgccccaaattggacttgtttctgccgttaatttccaaggtaattc

SEQ ID NO: 107 - DNA, 49 bp, Artificial Sequence
  Sequence of indel mutation recovered from expression of Cas9 from TMV vector and sgRNA from pJL 122 in N. benthamiana cells
atgccccaaattggacttgtttctgccgttaatttgaccaaggtaattc

SEQ ID NO: 108 - DNA, 45 bp, Artificial Sequence
  Sequence of indel mutation recovered from expression of Cas9 from TMV vector and sgRNA from pJL 122 in N. benthamiana cells
atgccccaaattggacttgtttctgccgttaatccaaggtaattc

SEQ ID NO: 109 - DNA, 47 bp, Artificial Sequence; identical to SEQ ID NO: 106
  Sequence of indel mutation recovered from expression of Cas9 from TMV vector and sgRNA from pJL 122 in N. benthamiana cells

SEQ ID NO: 110 - DNA, 54 bp, Artificial Sequence
  Sequence of indel mutation recovered from expression of Cas9 from TMV vector and sgRNA from pJL 122 in N. benthamiana cells
atgccccaaattggacttgtttctgccgttaatttgagagttccaaggtaattc

SEQ ID NO: 111 - DNA, 53 bp, Artificial Sequence
  Sequence of indel mutation recovered from expression of Cas9 from TMV vector and sgRNA from pJL 122 in N. benthamiana cells
atgccccaaattggacttgtttctgccgttaatttgagagtccaaggtaattc

SEQ ID NO: 112 - DNA, 42 bp, Artificial Sequence
  Example of Cas9 triggered indel mutation recovered from transient expression of Cas9 from pJL 125 T-DNA and sgRNA from the TMV vector in pJL 155 in N. benthamiana cells
atgccccaaattgacttgtttctgccgttaatttccaaggta

SEQ ID NO: 113 - DNA, 42 bp, Artificial Sequence; identical to SEQ ID NO: 112
  Example of Cas9 triggered indel mutation recovered from transient expression of Cas9 from pJL 125 T-DNA and sgRNA from the TMV vector in pJL 155 in N. benthamiana cells

SEQ ID NO: 114 - DNA, 49 bp, Artificial Sequence
  Example of Cas9 triggered indel mutation recovered from transient expression of Cas9 from pJL 125 T-DNA and sgRNA from the TMV vector in pJL 155 in N. benthamiana cells
atgccccaaattgacttgtttctgccgttaatttgagagttccaaggta

SEQ ID NO: 115 - DNA, 42 bp, Artificial Sequence; identical to SEQ ID NO: 112
  Example of Cas9 triggered indel mutation recovered from transient expression of Cas9 from pJL 125 T-DNA and sgRNA from the TMV vector in pJL 155 in N. benthamiana cells

SEQ ID NO: 116 - DNA, 42 bp, Artificial Sequence; identical to SEQ ID NO: 112
  Example of Cas9 triggered indel mutation recovered from transient expression of Cas9 from pJL 125 T-DNA and sgRNA from the TMV vector in pJL 155 in N. benthamiana cells

SEQ ID NO: 117 - DNA, 42 bp, Artificial Sequence; identical to SEQ ID NO: 112
  Example of Cas9 triggered indel mutation recovered from transient expression of Cas9 from pJL 125 T-DNA and sgRNA from the TMV vector in pJL 155 in N. benthamiana cells

SEQ ID NO: 118 - DNA, 48 bp, Artificial Sequence
  Example of Cas9 triggered indel mutation recovered from transient expression of Cas9 from pJL 125 T-DNA and sgRNA from the TMV vector in pJL 155 in N. benthamiana cells
atgccccaaattgacttgtttctgccgttaatttgagagtccaaggta

SEQ ID NO: 119 - DNA, 53 bp, Artificial Sequence; identical to SEQ ID NO: 111
  Example of indel mutation recovered from leaf cells infiltrated (exposed to) Agrobacterium cultures carrying pJL 159

SEQ ID NO: 120 - DNA, 47 bp, Artificial Sequence; identical to SEQ ID NO: 106
  Example of indel mutation recovered from leaf cells infiltrated (exposed to) Agrobacterium cultures carrying pJL 159

SEQ ID NO: 121 - DNA, 45 bp, Artificial Sequence; identical to SEQ ID NO: 108
  Example of indel mutation recovered from leaf cells infiltrated (exposed to) Agrobacterium cultures carrying pJL 159

SEQ ID NO: 122 - DNA, 47 bp, Artificial Sequence; identical to SEQ ID NO: 106
  Example of indel mutation recovered from leaf cells infiltrated (exposed to) Agrobacterium cultures carrying pJL 159

SEQ ID NO: 123 - DNA, 47 bp, Artificial Sequence; identical to SEQ ID NO: 106
  Example of indel mutation recovered from leaf cells infiltrated (exposed to) Agrobacterium cultures carrying pJL 159

SEQ ID NO: 124 - DNA, 45 bp, Artificial Sequence; identical to SEQ ID NO: 108
  Example of indel mutation recovered from leaf cells infiltrated (exposed to) Agrobacterium cultures carrying pJL 159

SEQ ID NO: 125 - DNA, 53 bp, Artificial Sequence
  Example of indel mutation recovered from leaf cells infiltrated (exposed to) Agrobacterium cultures carrying pJL 165
tgccccaaattggacttgtttctgccgttaatttgagagtccaaggtaattca

SEQ ID NO: 126 - DNA, 48 bp, Artificial Sequence
  Example of indel mutation recovered from leaf cells infiltrated (exposed to) Agrobacterium cultures carrying pJL 165
tgccccaaattggacttgtttctgccgttaatttccaaggtaattcag

SEQ ID NO: 127 - DNA, 46 bp, Artificial Sequence
  Example of indel mutation recovered from leaf cells infiltrated (exposed to) Agrobacterium cultures carrying pJL 165
tgccccaaattggacttgtttctgccgttaatccaaggtaattcag

SEQ ID NO: 128 - DNA, 46 bp, Artificial Sequence; identical to SEQ ID NO: 127
  Example of indel mutation recovered from leaf cells infiltrated (exposed to) Agrobacterium cultures carrying pJL 165

SEQ ID NO: 129 - DNA, 46 bp, Artificial Sequence; identical to SEQ ID NO: 127
  Example of indel mutation recovered from leaf cells infiltrated (exposed to) Agrobacterium cultures carrying pJL 165

SEQ ID NO: 130 - DNA, 53 bp, Artificial Sequence
  Indel mutation recovered from plant cells infected with the recombinant self-replicating RNA produced by T7 in vitro transcription reactions of the pJL 186 vector and the pJL 187 vector
tctgccgttaatttccaaggtaattcagcttatctttggagctcgaggtcttc

SEQ ID NO: 131 - DNA, 53 bp, Artificial Sequence; identical to SEQ ID NO: 130
  Indel mutation recovered from plant cells infected with the recombinant self-replicating RNA produced by T7 in vitro transcription reactions of the pJL 186 vector and the pJL 187 vector

SEQ ID NO: 132 - DNA, 56 bp, Artificial Sequence
  Indel mutation recovered from plant cells infected with the recombinant self-replicating RNA produced by T7 in vitro transcription reactions of the pJL 186 vector and the pJL 187 vector
tctgccgttaatttgatccaaggtaattcagcttatctttggagctcgaggtcttc

SEQ ID NO: 133 - DNA, 59 bp, Artificial Sequence
  Indel mutation recovered from plant cells infected with the recombinant self-replicating RNA produced by T7 in vitro transcription reactions of the pJL 186 vector and the pJL 187 vector
tctgccgttaatttgagagtccaaggtaattcagcttatctttggagctcgaggtcttc

SEQ ID NO: 134 - DNA, 59 bp, Artificial Sequence; identical to SEQ ID NO: 133
  Indel mutation recovered from plant cells infected with the recombinant self-replicating RNA produced by T7 in vitro transcription reactions of the pJL 186 vector and the pJL 187 vector

SEQ ID NO: 135 - DNA, 59 bp, Artificial Sequence; identical to SEQ ID NO: 133
  Indel mutation recovered from plant cells infected with the recombinant self-replicating RNA produced by T7 in vitro transcription reactions of the pJL 186 vector and the pJL 187 vector

SEQ ID NO: 136 - DNA, 60 bp, Artificial Sequence
  Indel mutation recovered from plant cells infected with the recombinant self-replicating RNA produced by T7 in vitro transcription reactions of the pJL 186 vector and the pJL 187 vector
tctgccgttaatttgagagttccaaggtaattcagcttatctttggagctcgaggtcttc

SEQ ID NO: 137 - DNA, 56 bp, Artificial Sequence
  Indel mutation recovered from plant cells infected with the recombinant self-replicating RNA produced by T7 in vitro transcription reactions of the pJL 186 vector and the pJL 187 vector
tctgccgttaatttgagccaaggtaattcagcttatctttggagctcgaggtcttc

SEQ ID NO: 138 - DNA, 60 bp, Artificial Sequence; identical to SEQ ID NO: 136
  Indel mutation recovered from plant cells infected with the recombinant self-replicating RNA produced by T7 in vitro transcription reactions of the pJL 186 vector and the pJL 187 vector

SEQ ID NO: 139 - DNA, 59 bp, Artificial Sequence; identical to SEQ ID NO: 133
  Indel mutation recovered from plant cells infected with the recombinant self-replicating RNA produced by T7 in vitro transcription reactions of the pJL 186 vector and the pJL 187 vector

SEQ ID NO: 140 - DNA, 59 bp, Artificial Sequence; identical to SEQ ID NO: 133
  Indel mutation recovered from plant cells infected with the recombinant self-replicating RNA produced by T7 in vitro transcription reactions of the pJL 186 vector and the pJL 187 vector

SEQ ID NO: 141 - DNA, 54 bp, Artificial Sequence
  Indel mutation recovered from plant cells infected with the recombinant self-replicating RNA produced by T7 in vitro transcription reactions of the pJL 186 vector and the pJL 187 vector
tctgccgttaattttccaaggtaattcagcttatctttggagctcgaggtcttc

SEQ ID NO: 142 - DNA, 53 bp, Artificial Sequence; identical to SEQ ID NO: 130
  Indel mutation recovered from plant cells infected with the recombinant self-replicating RNA produced by T7 in vitro transcription reactions of the pJL 186 vector and the pJL 187 vector

SEQ ID NO: 143 - DNA, 56 bp, Artificial Sequence; identical to SEQ ID NO: 137
  Indel mutation recovered from plant cells infected with the recombinant self-replicating RNA produced by T7 in vitro transcription reactions of the pJL 186 vector and the pJL 187 vector

SEQ ID NO: 144 - DNA, 53 bp, Artificial Sequence; identical to SEQ ID NO: 130
  Indel mutation recovered from plant cells infected with the recombinant self-replicating RNA produced by T7 in vitro transcription reactions of the pJL 186 vector and the pJL 187 vector

SEQ ID NO: 145 - DNA, 60 bp, Artificial Sequence; identical to SEQ ID NO: 136
  Indel mutation recovered from plant cells infected with the recombinant self-replicating RNA produced by T7 in vitro transcription reactions of the pJL 186 vector and the pJL 187 vector

SEQ ID NO: 146 - DNA, 19 bp, Artificial Sequence
  Illustrative transcriptional start site for subgenomic promoters of the present disclosure
atcggattcgttttaaata

SEQ ID NO: 147 - DNA, 100 bp, Artificial Sequence
  Illustrative example of minimally active subgenomic promoters of the present disclosure
ggattttggaggaatgagttttaaaaagaataatttaatcgatgatgattcggaggctactgtcgccgaatcggattcgttttaaatagatcttacagta

SEQ ID NO: 148 - DNA, 230 bp, Artificial Sequence
  Illustrative example of fully active subgenomic promoters of the present disclosure
ctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtcattaattaacc

SEQ ID NO: 149 - protein, 1616 aa, Tomato mottle mosaic virus
  misc_feature (1117)..(1117): Xaa can be any naturally occurring amino acid
MAYTQTATSSALLDTVRGNNTLVNDLAKRRLYDTAVDEFNARDRRPKVNFSKVVSEEQTLIATRAYPEFQITFYNTQNAVHSLAGGLRSLELEYLMMQIPYGSLTYDIGGNFASHLFKGRAYVHCCMPNLDVRDIMRHEGQKDSVELYFARLERGNKFVPNFQKEAFDRYAETPDEVVCHDTFQTCRHSQEMYTGRVYAIALHSIYDIPADEFGAALLRKNVHVCYAAFHFSENLLLEDSHVNLDEINACFQRDGDRLTFSFASESTLNYSHSFSNILKYVCKTYFPASNREVYMKEFLVTRVNTWFCKFSRIDTFLLYKGVAHKGVDSEQFYKAMEDAWHYKKTLAMCNSERILLEDSSSVNYWFPKMRDMVIVPLFDICLETSKRSRKEVLVSKDFVYTVLNHIRTYQAKALTYANVLSFVESIRSRVIINGVTARSEWDVDKSLLQSLSMTFFLHTKLSVLKDDLLISKFSLGPKPVSQLVWEEISSAFGNAFPTIKERLINRKLIQITENALEIRVPDLYVTFHDRLVSEYKLSVEMPALDIRKKMEETEVMYNALSELSVLKNSDKFDVDVFSQMCQSLEVDPMTAAKVIVAVMSNESGLTLTFEQPTEANVALALQDSEKASEGALVVTSRDVEEPSMKGSMARGELQLAGLAGDIPESSFTRSEEIESLEQFHMATASSLIQKQMCSIVYTGTIKVQQMKNFIDSLVASLSAAVSNLVKILKDTAAIDLETRQKFGVLDVTSKKWLIKPSAKNHAWGVVETHARKYHVALLEYDEFGVITCDDWRRVAVSSESVVYSDMAKLRTLRKLLLDGEPPVSSAKVVLVDGVPGCGKTKEILSKVNFDEDLILVPGRQAAEMIRRRANSSGVIVATKDNVRTVDSFIMNYGKGGRCQFKRLFIDEGLMLHTGCVNFLVTMSLCDIAYVYGDTQQIPYINRVTGFPYPAHFSKLEVDEVETRRTTLRCPADVTHFLNQRYEGYVMCTSAEKKSVSQEMVSGAATINPVSKPLSGKVLTFTQSDKEALLSRGYSDVHTVHEVQGETYADVSLVRLTPTPVSIIARDSPHVLVALSRHTKSFKYYTVVMDPLVSIIRELEQVSSYLLDMYKVEAGTQXQLQVDSVFKGSNLFVAAPKTGDISDMQFYYDKCLPGNSTMLNNFDAVTMKLTDISLNVKDCTLDMSKSVAAPKDEKATLIPMVRTAAEMPRQTGLLENLVAMIKRNFNSPELSGVVDIENTASLVVDKFFDSYLLKEKRKPNKNFSLFSRESFNRWLAKQEQVTIGQLSDFDFVDLPAVDQYRHMIKAQPKQKLDTSIQTEYPALQTIVYHSKKINAIFGPLFSELTRQLLDSVDSSRFLFFTRKTPAQIEDFFGDLDSHVPMDVLELDISKYDKSQNEFHCAVEYEIWRRLGLEDFLAEVWKQGHRKTTLKDYTAGIKTCLWYQRKSGDVTTFIGNTVIIAACLASMLPMEKLIKGAFCGDDSLLYFPKGCEFPDIQQAANLMWNFEAKLYKKKYGYFCGRYVIHHDRGCIVYYDPLKLISKLGAKHIKDWDHLEEFRRSLCDVAGSLNNCAYYMQLDDAVGEVHKTAPPGSFVYKSLVKYLSDKVLFRSLFINGSNC

SEQ ID NO: 150 - protein, 1615 aa, Tomato brown rugose fruit virus
  misc_feature (1117)..(1117): Xaa can be any naturally occurring amino acid
MAYTQTATTSALLDTVRGNNTLVNDLAKRRLYDTAVDEFNARDRRPKVNFSKVISEEQTLIATRAYPEFQITFYNTQNAVHSLAGGLRSLELEYLMMQIPYGSLTYDIGGNFASHLFKGRAYVHCCMPNLDVRDIMRHEGQKDSIELYLSRLERGNKVVPNFQKEAFDRYAETPDEVVCHSTFQTCTHQQVENTGRVYAIALHSIYDIPADEFGAALLRKNVHVCYAAFHFSENLLLEDSHVNLDEINACFSRDGDKLTFSFASESTLNYCHSYSNILKYVCKTYFPASNREVYMKEFLVTRVNTWFCKFSRIDTFLLYKGVAHKGVNSEQFYSAMEDAWHYKKTLAMCNSERILLEDSSSVNYWFPKMRDMVIVPLFDISLDTSKRTRKEVLVSKDFVFTVLNHIRTYQAKALTYSNVLSFVESIRSRVIINGVTARSEWDVDKSLLQSLSMTFFLHTKLAVLKDELLISKFSLGPKSVSQHVWDEISLAFGNAFPSIKERLLNRKLIKVSGDALEIRVPDLYVTFHDRLVTEYKTSVDMPVLDIRKRMEETEVMYNALSELSVLKESDKFDVDVFSRMCQTLEVDPMTAAKVIVAVMSNESGLTLTFEQPTEANVALALKDSEKASEGALVVTSRDVEEPSMKGSMARGELQLAGLSGDQPESSYTRNEEIESLEQFHMATASSLIRKQMSSIVYTGPIKVQQMKNFIDSLVASLSAAVSNLVKILKDTAAIDLETRQKFGVLDVATKRWLIKPLAKNHAWGVIETHARKYHVALLEYDEHGVVTCDSWRRVAVSSESMVYSDMAKLRTLRRLLRDGEPHVSSAKVVLVDGVPGCGKTKEILSKVNFEEDLILVPGKQAAEMIKRRANASGIIQATRDNVRTVDSFIMNYGKGTRCQFKRLFIDEGLMLHTGCVNFLVSMSLCEIAYVYGDTQQIPYINRVSGFPYPAHFAKIEVDEVETRRTTLRCPADITHYLNRRYEGYVMCTSSVKKSVSQEMVSGAAMINPVSKPLNGKVLTFTQSDKEALLSRGYTDVHTVHEVQGETYADVSLVRLTPTPVSIIAGDSPHVLVALSRHTQTLKYYTVVMDPLVSIIRDLEKLSSYLLDMYKVDAGTQXQLQVDSVFKGSNLFVAAPKTGDISDMQFYYDKCLPGNSTMLNNYDAVTMRLTDISLNVKDCILDFSKSVAAPKDPIKPLIPMVRTAAEMPRQTGLLENLVAMIKRNFNSPELSGIIDIENTASLVVDKFFDSYLLKEKRKPNKNVSLFCRESLNRWLEKQEQVTIGQLADFDFVDLPAVDQYRHMIKAQPKQKLDTSIQSEYPALQTIVYHSKKINAIFGPLFSELTRQMLESIDSSKFLFFTRKTPAQIEDFFGDLDSHVPMDILELDISKYDKSQNEFHCAVEYEIWRRLGLEDFLGEVWKQGHRKTTLKDYTAGIKTCLWYQRKSGDVTTFIGNTVIIAACLASMLPMEKIIKGAFCGDDSLLYFPKGCEFPDIQHTANLMWNFEAKLFRKQYGYFCGRYVIHHDRGCIVYYDPLKLISKLGAKHIKDWDHLEEFRRSLCDVANSLNNCAYYTQLDDAVSEVHKTAPPGSFVYKSLVKYLSDKVLFRSLFIDGSC

SEQ ID NO: 151 - protein, 1616 aa, Rehmannia mosaic virus
  misc_feature (1117)..(1117): Xaa can be any naturally occurring amino acid
MAYTQTATTSALLDTVRGNNTLVNDLAKRRLYDSAVEEFNARDRRPKINFSKVISEEQTLIATRAYPEFQITFYNTQNAVHSLAGGLRSLELEYLMMQVPYGSLTYDIGGNFASHLFKGRAYVHCCMPNLDVRDIMRHEGQKDSIELYLSRLDRGNKVVPSFQKEAFDKYAESPQDVVCHNTFQTCEHQQLQNSGRVYAIALHSIYDIPADEFGAALLRKNVHTCYAAFHFSESLLLEDSYVNLDEINACFSRDGDKLTFSFASESTLNYSHSYSNILKYVCKTYFPASNREVYMKEFLVTRVNTWFCKFSRIDTFLLYKGVAHKSVDSEQFYTAMEDAWHYKKTLAMCNSERILLEDSSSVNYWFPKMRDMVIVPLFDISLETSKRTRKEVLVSKDFVFTVLNHIRTYQAKALTYSNVLSFVESIRSRVIINGVTARSEWDVDKSLLQSLSMTFFLHTKLAVLKDDLMISKFSLGPKTVGQHIWDEISLAFGSAFPSIKERLLNRKLIKVAGDALEIRVPDLYVTFHDRLVTEYKASVDMPALDIRKRMEETEVMYNALSELSVLKESDKFDVDVFSQMCQNLEVDPMTAAKVIVAVMSNESGLTLTFEQPTEANVALALHDSEKASEGALVVTSRDVEEPSMKGSMARGELQLAGLIGDHPESSYTKNEEIESLEQFHMATAESLIRKQMSSIVYTGPIKVQQMKNFIDSLVASLSAAVSNLVKILKDTAAIDLETRQKFGVFDVVSRKWLIKPTAKSHAWGVVETHARKYHVALLEYNEQGIIACDSWRRVAVSSESVVYSDMAKLKTLRKLLHNGEPQVSTARVVLVDGVPGCGKTKEILSRVNFEEDLILVPGKQAAEMIKRRANASGVIVATKDNVRTVDSFMMNYGKVARCQFKRLFIDEGLMLHTGCVNFLVSMSLCDIAYIYGDTQQIPYINRVTGFPYPAHFAKLEVDEVETRRTTLRCPADVTHYLNKRYEGFVMSTSSVKKSVSQEMVSGAATINPISKPLHGKVLTFTQSDKEALLSRGYSDVHTVHEVQGETYSDVSLVRLTPTPVSIISGDSPHVLVALSRHTCSLKYYTVVMDPLVSIIRDLEKLSTYLLDMYKVDAGTQXQLQIDSVFKGSNLFVAAPKTGDISDMQFYYDKCLPGNSTMMNNYDAVTMRLTDISLNVKDCILDMSKSVAAPKDSNIPLIPMVRTAAEMPRQTGLLENLVAMIKRNFNAPELSGIVDIENTASLVVDRFFDSYLLKEKRKPNKNVSLFSRESLNRWLEKQEQATIGQLADFDFVDLPAVDQYRHMIKAQPKQKLDTSIQTEYPALQTIVYHSKKINAIFGPLFSELTRQLLDSVDSSRFLFFTRKTPAQIEEFFGDLDSHVPMDVLELDISKYDKSQNEFHCAVEYEIWRRLGFEDFLGEVWKQGHRKTTLKDYTAGIKTCIWYQRKSGDVTTFIGNTVIIAACLASMLPMEKIIKGAFCGDDSLLYFPKGCEFPDVQQAANLMWNFEAKLFKKQYGYFCGRYVIHHDRGCIVYYDPLKLISKLGAKHIKDWDHLEEFRRSLCDVAVSLNNCAYYTQLDDAVWEVHKTAPAGSFVYKSLVKYLSDKVLFRSLFLDGSSC

SEQ ID NO: 152 - protein, 1637 aa, Pepper mild mottle virus
  misc_feature (1143)..(1143): Xaa can be any naturally occurring amino acid
VVVNSSQFNNNNTNNKQHYKQITTTMAYTQQATNAALASTLRGNNPLVNDLANRRLYESAVEQCNAHDRRPKVNFLRSISEEQTLIATKAYPEFQITFYNTQNAVHSLAGGLRSLELEYLMMQIPYGSTTYDIGGNFAAHMFKGRDYVHCCMPNMDLRDVMRHNAQKDSIELYLSKLAQKKKVIPPYQKPVFDKYTDDPQSVVCSKPFQHCEGVSHCTDKVYAVALHSLYDIPADEFGAALLRRNVHVCYAAFHFSENLLLEDSYVSLDDIGAFFSREGDMLNFSFVAESTLNYTHSYSNVLKYVCKTYFPASSREVYMKEFLVTRVNTWFCKFSRLDTFVLYRGVYHRGVDKEQFYSAMEDAWHYKKTLAMMNSERILLEDSSSVNYWFPKMKDMVIVPLFDVSLQNEGKRLARKEVMVSKDFVYTVLNHIRTYQSKALTYANVLSFVESIRSRVIINGVTARSEWDVDKALLQSLSMTFFLQTKLAMLKDDLVVQKFQVHSKSLTEYVWDEITAAFHNCFPTIKERLINKKLITVSEKALEIKVPDLYVTFHDRLVKEYKSSVEMPVLDVKKSLEEAEVMYNALSEISILKDSDKFDVDVFSRMCNTLGVDPLVAAKVMVAVVSNESGLTLTFERPTEANVALALQPTIASKEEGSLKIVSSDVGESSIKEVVRKSEISMLGLTGSTVSDEFQRSTEIESLQQFHMVSTETIIRKQMHAMVYTGPLKVQQCKNYLDSLVASLSAAVSNLKKIIKDTAAIDLETKEKFGVYDVCLKKWLVKPQSKGHAWGVVMDSDYKCFVALLTYDGENIVCGETWRRVAVSSESLVYSDMGKIRAIRSVLKDGEPHISSAKVTLVDGVPGCGKTKEILSRVNFDEDLVLVPGKQAAEMIRRRANSSGLIVATKENVRTVDSFLMNYGRGPCQYKRLFLDEGLMLHPGCVNFLVGMSLCSEAFVYGDTQQIPYINRVATFPYPKHLSQLEVDAVETRRTTLRCPADITFFLNQKYEGQVMCTSSVTRSVSHEVIQGAAVMNPVSKPLKGKVITFTQSDKSLLLSRGYEDVHTVHEVQGETFEDVSLVRLTPTPVGIISKQSPHLLVSLSRHTRSIKYYTVVLDAVVSVLRDLECVSSYLLDMYKVDVSTQXQLQIESVYKGVNLFVAAPKTGDVSDMQYYYDKCLPGNSTILNEYDAVTMQIRENNLNVKDCVLDMSKSVPLPRESETTLKPVIRTAAEKPRKPGLLENLVAMIKRNFNSPELTGVVDIEDTASLVVDKFFDAYFIKEKKKPKNIPLLSRASLERWIEKQEKSTIGQLADFDFIDLPAVDQYRHMIKQQPKQRLDLSIQTEYPALQTIVYHSKKINALFGPVFSELTRQLLESIDSSRFMFYTRKTPTQIEEFFSDLDSNVPMDILELDISKYDKSQNEFHCAVEYEIWKRLGLDDFLAEVWKHGHRKTTLKDYTAGIKTCLWYQRKSGDVTTFIGNTIIIAACLSSMLPMERLIKGAFCGDDSILYFPKGTDFPDIQQGANLLWNFEAKLFRKRYGYFCGRYIIHHDRGCIVYYDPLKLISKLGAKHIKNREHLEEFRTSLCDVAGSLNNCAYYTHLDDAVGEVIKTAPPGSFVYRALVKYLCDKRLFQTLFLE

SEQ ID NO: 153 - protein, 1612 aa, Tropical soda apple mosaic virus
  misc_feature (1118)..(1118): Xaa can be any naturally occurring amino acid
MAYTQQATTAALASTLRGNNPLVNDLANRRLYDSAVEQCNAHDRRPKVNFPKTISEEQTLIATKAYPEFQITFFNTQNAVHSLAGGLRTLELEYLMMQIPYGSTTYDIGGNFAAHMFKGRDYVHCCMPNMDLRDVMRHNSQKESIELYLSRLAQRNKVIPSFQKPCFDKYTDDPQSVVCSKPFQHCDGVSNCTDKVYAIALHSLYDIPADEFGAALLRRGVNVCYAAFHFSENLLLEDSYVSLDDIGATFSREGDVLNFSFVAESTLNYSHSYSNVLKYVCKTYFPASTREVYMKEFLVTRVNTWFCKFSRIDTFVLYRGVYHRGVDKEQFYTAMEDAWHYKKTLAMMNSERILLEDSSSVNYWFPKMKDMVIIPLFDISLQNENKRMSRREVMVSKDFVYTVLNHIRTYQSKALTYANVLSFVESIRSRVIINGVTARSEWDVDKALLQSLSMTFFLQTKLAVLKDELLINKFQVHSKSLTEYVWDEVTSAFHGCFPSIKERLIKQNLISVSEKALEIKVPDLYVTFHDRLVREYRCSVDMPTVDVRKSLEKAELMYNALSEISVLKDSDKFDVNVFSQMCDNLGVDPLVAAKVMVAVVSNESGLTLTFERPTEANVALALQPTIASKESGVLKIVSSDVGESSIKEVVQKSEISMLGLTGDTISDEFQRSTEIESLQQFHMASTDAIIRKQMHAMVYTGPLKVQQCKNYLDNLVASLSAAVSNLKKIIRDTAAIDLETREKFGVFDVCSGKWLVKPSTKGHAWGVVMDSNYKCFVALLTYDGDNIVCGETWRRVAVSSESMVYSDMGKIRAIRSVLRDGEPLISSARVTLVDGVPGCGKTKEILARVNLDEDLILVPGKQAAEMIRRRANSSGLIVATKDNVKTVDSFLMNYGRGRCQYKRLFVDEGLMLHPGCVNFLVAMSLCDEAFIYGDTQQIPYINRVANFPYPKHLSQLEVDDVETRRTTLRCPADITHFLNQRYEGQVMCTSTVVRSVAQEVVQGAAVMNPVSKPLKGKVITFTQADKSMLLSRGYTDVNTVHEVQGETYEDVSLVRLTPTPVGIISKESPHLLVALSRHTRSVKYYTVVVDAVVSVLRDLECVSSYLLDMYKVDVSVQXQLQVEAVYKGENLFVAAPKTGDISDMQFYYDKCLPGNSTVLNEYDAVTMQIRDNKLNVKDCVLDMSKSVPLPRETGKSLKPVIRTAAEMPRKPGLLENLVAMVKRNFNSPELSGIVDIEDTASYVVDKFFDAYLLKEKKKPKDLPLLSRASLERWIGKQEKSTIGQLADFDFIDLPAVDQYRHMIKQQPKQRLDLTIQTEYPALQTIVYHSKKINALFGPVFSELTRQLLDMIDSSRFMFYTRKTPSQIEEFFSDLDSEVPMDILELDISKYDKSQGEFHCAVEYEIWRRLGLDDFLAEVWKHGHRKTTLKDYTAGIKACLWYQRKSGDVTTFIGNTVIIAACLSSMLPMDSLIKGAFCGDDSILYFPKGSQFPDVQQCANLMWNFEAKLFRKKYGYFCGRYIIHHDRGCIVYYDPLKLISKLGAKHIKDREHLEEFRTSLCDVAGSLNNCAYYTQLDEAVSEIIKTAPPGSFVYKSLVKFLCDKRLFQSLFLD

SEQ ID NO: 154 - protein, 1613 aa, Brugmansia mild mottle virus
  misc_feature (1116)..(1116): Xaa can be any naturally occurring amino acid
MAHTQTTMQNALLDNVRGNNTLVNDLARRRMYDIAVDEFQAKDRRPKINFSKAISEEQTLIATDNYPEFQITFYNTQNAVHSLAGGLRALELEYLMMQVPYGSTTFDIGGNFAAHLFKGRDYVHCCMPNLDCRDIMRHENQKDSVDMYLQRLKKSGKVIPHFQKPAFDRYCETPADVVCHDTFQSCSYDVSRNGAGRNYAIALHSIYDIPADDFGAALMRKNVHTCYAAFHFSEELLLENTHVSLEEIGAMFTREGDSLSFCFVNESTLNYSHSYSNLLRYVCKTYFPASSTVVYMKEFLVTRVNTWFCKFTQVDTCFLHRGVHLRGADREAFYAGMEDAWHYKKTLALINSERVMLNDAASINFWFPKMKDKVIIPLFDISIDTYKRSRKEVLIDKDFVYTVLNHIRTYQAKALTYANVLSFVESIRSRVIINGVTARAEWNVDKALLQSLSMTFFLQTKLAMLKDDLMISKFKVGAKTLSEHVWDEVRATLGNVFPSVKEGLIRRKLISVSANALEIKVPDLYTTFQDRFVSEYNSLVEMPTMNIVKQIEDAEQMYNAMSELSVLENSDKFDVTIFSEMCKNLEVDPYTAAKVIVAVLQNESGVTLTFSKPTEINVATALAASEVEGEEIVLSSKPAEYVSTRSMVAEGKLPMEGLIGDCSSSSMHLNPEIESLSQFHCASVDSLIKKQMASIVYTGPLKVQQMKNYMDSLSASLSASVSNLKKIIRDTVTVDSEPGKFGVWDVSKRSWIVKPASKGHAWGVVELHNGKLKLMLLEYSGAEMICEASWRRVAVSTDSMVYSDMKKLQTLRGCLKDGEPHVSSAKVTLVDGVPGCGKTKEILQRVDLETDLILVPGKQAAAMIRKRANAKGLIVATTENVKTVDSFLMNLGKKPLGRVENLFIDEGLMLHPGCVNFLVSLTMCDRAFVFGDTQQIPYINRVQNFPYPKHFATLEVDEVETRRVTMRCPADVTHFLNERYSGTVMCSSGVQKSVSSEILVGAGSVNPITKPLKGKILTFTQSDKFALTERGYEDVNTVHEVQGETYEDVSVVRLTPTPLALISRDSPHVLVCLSRHTKSFKYYTVVLDPLVSLVRDLEKVSHYLLDMYKVSAGQQXQLQVGFEFIRSNLFVQAPKTGDVQDMQFYYDACLPGNSTILNNFDAVTMRLMDNKLNVKDCTIDMSKAVAMPKEKKQPLLPVIRTAAEMPRESGLLENLVAMIKRNFNAPDLSGIVDIENTASFVVDKFFDSYFLKEKQKRKDLFTMSRSVLESWLSKQESVTIGQLADFDFIDLPAVDQYRHMIKAQPKQKLDLSIQSEYPALQTIVYHSKKINAIFGPLFSELTRQMLEQIDASRFMFFTRKTPGQIEEFFSDLDSHVPMDILELDVSKYDKSQNEFHCAVEYEIWRRMGLDEYLAEVWKQGHRKTTLKDYTAGIKTCLWYQRKSGDVTTFIGNTVIIAACLASMLPMDKVIKGAFCGDDSLIYLPKGCELPDIQACANLMWNFEAKLYRKKYGYFCGRYVIHHDRGAIVYYDPLKLISKLGAKHIMDEQHLEEFRTSLCDVASSLNNCAYYLQLDDAIREVHKTAPGGSFVFKAIVKFLSDKVLFKQLFTSYDS

SEQ ID NO: 155 - protein, 1614 aa, Yellow tailflower mild mottle virus
  misc_feature (1120)..(1120): Xaa can be any naturally occurring amino acid
MAQTQQAITNALLDTMRGNNPLVNDLAKRRLYDTAVEEMNTRDRRPKVNFSKSINEEQTLVVSQAYPEFQITFYNTQLAVHSMAAGLRNLELEYMMMQVPYGSLTYDIGGNFASHLFKGRDYVHCCMPNLDVRDVMRHENQKDAVEVYLGKLASKGRPIPHFQLPAFERYANSPDAVVCHDTFQQCKHDPFQHDGRKYAVALHSLYDIPADEFGAALLRKDIHTCYAAFHFAEELLLEASTVELPAIGGVFSRDGDRLNFCFSNESTLNYSHSYSNVLKFVCKTYFLASNRYVYMKEFLVTRVNTMFCKFVKVDTYMLYKSVYKNSVDSEQFYASMEDAWHYKKTLAMLNSERIMLHDKSAVNFWFPKMKDQVIVPLFDISLDSGKRTRKEVLVNKDFVYTVLNHIRTYQAKALTYNNVLSFVESIRSRVIINGVTARSEWDVDKTLLQGLSMTFFLITKLAILKDEMMISKFKLGSKSISEHVWEECEKAFGNLFPSLKEVLKRRKLIVTSESALEIKVPDVYVTFHDRFVSEYQSSVEMPSMDISKSLTEAEKYYEALSELTVVKGMKDFDAEKFTRMCQLYSVSPELAAKIITAVFANESGVSIPFKQATEENLSEALSSTQKEDDVLVLTSTYQSERVDTASMVETGQLPMQGICKDIGTACFEHNEEINTLEDFHMMAAESVVQGNMASIIYQGSLQVQQMENYVDSLAASLSASVSNLKKAIKDTSGFVSDSQSKYGVYDVRKKTWLLQPSGKNHAWGVVEKYNGKCFLALLKHENSVPICHEDWRRVAVSSESLIYSDMAKLRNLRRSIPEGGKPFLSSAEMILVDGVPGCGKTKEILSRVNLEEDLILVPGREAAAMIRKRANASMNGLTVANNENVKTVDSFLMNLGKGCKKQWKNLYIDEGLMLHPGCVYFLVGLSHCEKAYIFGDTQQIPFINRVQNFPFPAHFAKLQVDSVEKRRTTLRCPADVTHFLNERYEGAVTCTSSVDRSVSFEIVAGSAAVNPVSKPLKGKVITFTQSDKSTLVARGYENVNTVHEIQGETYEEVSLVRLTPTPIGIISRDSPHVLVALSRHTKAFKYYTVVLDSMVSVVRDLESVSNFLLDVYKVESSSLXQLQVDAVYINENLFVQAPKTGDVQDLQFYYDRCLPGNSTVLNDFDAVTINLSDISLNSKDCVLEFSKSVPLPRDRPSVLTPVIRTAAEKPREAGLLENLIAMIKRNFNSPELSGIVDIENTASVVVDKFFESYILNDIKKPKNMYSLDRQSLIRWMEKQEPATLGQLADFDFIDLPAIDQYKHMIKSQPKQKLDLSIQTEYPALQTIVYHSKKINSLFGPVFSELTRQLLASIDSSRFMFYTRKTPEQIEEFFSDLDSHVPMDVLELDVSKYDKSQNEFHCAVEYEIWRRLGIDEFLAEVWKQGHRKTTLKDYVAGIRTCLWYQRKSGDVTTFIGNTVIIAACISSMVPMDKVIKAAFCGDDSLIYIPKGTQMPDIQAGANLMWNFEAKLFKKRYGYFCGRYVIHHDRGAIVYVDPLKIISKLGAKHIKDKEHLEEFRVSLMDVCKSLNNCSYYLQLDEAIGEVHKTAPPGSFVFKCLVKYLSDKKLFESLFLK

SEQ ID NO: 156 - protein, 1616 aa, Paprika mild mottle virus
  misc_feature (1116)..(1116): Xaa can be any naturally occurring amino acid
MAHLQQSMQGALLDTIRGQNSLVNDLAKRKLYDTAVEEFNAKDRRPKVNFSKTINEEQTLVVSQAYPEFQITFYNTQLAVHSLAAGLRTLELEYLMMQIPYGSLTYDIGGNFAAHLFKGRDYVHCCMPNLDLRDIMRHENQKDSVATYISRLKARNKVIPAFQQDAFQRYAERSDEVVCSDTFQCCTSNRYHSGNRVYAIALHSLYDIPADELGAALLRKDVHTLYAAFHFAEELLLEASTVELPAIGGIFSRDGDRLDFCFSNESTLNYSHSYSNLLKYVCKTYFPASSRYVYMKEFLVTRVNTWFCKFTKLDTYTLYRGVYHRGCDQNEFYAAMEDAWHYKKTLAMLNTERIVLEDKSSVNYWFPKMRDMVIVPLFDVSLETQRRTRKEVLVNKDFVFTVLNHIRTYQAKALTYNNVLSFVESIRSRVIINGVTARSEWDVDKSLIQGLSMTFFLITKLSVLKDELLTSKFTLSTKSLSEHVWDEIKSACGSIFPSLKETLLRRKMISGSADKLEIKVPDTYVTFHDRFVSEYKSSVEMPTIDISKDLSEAECFYSALSELSVLENSKDFDLEKFSRMCALNSVNPEVAAKVIVAVLSNESGVTLPFKEPTEGNIAEALKPNGRDEVLTLENVTENTDLTYKSMVSSGSLPLCGISGEIACDTFVRNEEINSLEEYHMLAAESVINNRMASIVYSGPLQVQQMQNYVDSLVASLSATVSNLKKLVKDSSVGFQDALSKVGVFDARMKRWLIKPTLKNHSWGVVQKFDGKCFLAILSYDNENPICDADWCKVAVSNESMVYSDMAKLRVLKESMGDKPPHVSSAKVTLVDGVPGCGKTKEILRRVNFDEDLVLVPGKEAAAMIRKRANQCGNTVANNNNVRTVDSFLMNLGKSPRNHFKRLFIDEGLMLHPGCVYFLVTLSLCDEAFVFGDTQQIPYINRVQNFPFPKHFSKLIVDETEKRRTTLRCPVDVTHFLNQRYDGAVTTTSKTTRSVGVDVVNGAATMNPVTRPLKGKIITFTQSDKITLASRGYENVNTVHEIQGETYDDVCLVRLTPTPIHIIARDSPHVLVGLTRHTKTFKYYTVVLDPLVKIVRDLECVSNFLLDVYMVDSVNAXQLQVGSVYMSESLFVQAPKSGDVQDMQFYYDKCLPGNSTVLNDFDAVTINNADISLNVKDCTLDFSKSVPLPKDKLQSPLTPVIRTAAEKPRQSGLLENLVAMIKRNFNSPELSGIVDIENTASVVVDRFFDSYFLKDKISSCSLGDSGGKNIIDRQALIRWMEKQEKSTIGQLADFDFIDLPAIDQYRHIIKSQPKQKLDLSIQSEYPSLQTIVYHSKKINALFGPIFSELTRQMLSAIDSSRFLFFTRRTPEQIEEFFSDLDTSQPMEVLELDISKYDKSQNEFHCAVEYEIWRRLGIDDFLAEVWKQGHRRTTLKDFTSGIKTCLWYQRKSGDVTTFIGNTVIIAACLASMLPMEKVIKAAFCGDDSLVYLPKGCELPDIQSCANLMWNFEAKLFKKTYGYFCGRYVIHHDRGAIVYVDPLKIISKLGAKHITDREHLEEFRISLADVSKSLNNCAYYTQLDEAVREVHKTAPPGAFVYKCIVKFLSDKVLFKSLFL

SEQ ID NO: 157 - protein, 1616 aa, Obuda pepper virus
  misc_feature (1116)..(1116): Xaa can be any naturally occurring amino acid
MAHIQQSMQGALLDTVRGQNSLVNDLAKRRLYDTAVEEFNAKDRRPKINFSKSINEEQTLIVSQAYPEFQITFYNTQLAVHSLAAGLRSLELEYLMMQVPYGSLTYDIGGNFAAHLFKGRDYVHCCMPNLDLRDIMRHENQKDSVATYLSRLKARNKVLPAFQQEAFQRYSERSDEVVCNNTFQCCESNRYSSGGRVYAISLHSLYDIPADELGAALLRKNVHTLYAAFHFAEELLLEVSTVELPTIGGIFSRDGDKINFCFSNESTLNYSHSYSNLLKYVCKTYFPASNRFVYMKEFLITRVNTWFCKFTKLDTYTLYRGVYHRGCDQQEFYSAMEDAWHYKKTLAMLNSERIVLEDHSSVNYWFPKMKDMVIVPLFDVSLETQKRTKKEVIVSKDFVYTVLNHIRTYQAKALTYNNVLSFVESIRSRVIINGVTARSEWDVDKALLQSMAMTFFLITKLSMLKDELLVSKFTLSAKSVHEHVWDEIKRGCGNMFPSLKESLLRKKLISGSAEELEIEVPDMYVTFHDRFVAEYKASVEMPTIDISKDLSEAESYYSALSELSVLENSKDFDLEKFSRMCAINCVNPDIAAKIVVAVLSNESGVTLPFKEPTEGNMAEAMKSGEKDEVLTLGSQTDNTDLTSKSMVISGSLPLCGIASEISCDTFVRNEEINSLEEYHMLAAESVISNKMASIVYSGPLQVQQMQNYVDSLAASLSATVSNLKKLVKDSSVGFQDSLSKVGVFDVRKKMWLIKPTLKNHSWGVVQKFDGKCFLALLSYHNELPICDADWSKVAVSNESMVYSDMAKLRVLRKSIGEMPISVSSAKVTLVDGVPGCGKTKEILRRVNFSEDLVLVPGKEAAAMIRKRANQSGNIVANNDNVKTVDSFLMNLGKGPVCQFKRLFVDEGLMLHPGCVYFLVKLSLCNEAFVFGDTQQIPYINRVQNFPFPQHFSKLIVDETEKRRTTLRCPVDVTHFLNQCYDGAVTTTSKTQRSVGLEVVGGAAVMNPVTKPLKGKIVTFTQSDKLTMLSRGYQDVNTVHEIQGETYEEVSLVRLTPTPIHIISRESPHVLVGLTRHTRCFKYYTVVLDPLVKLVRDLECVSNFLLDVYMVDSVSAXQLQVSGVYLAENLFVQAPKSGDAQDLQFYYDKCLPGNSTVLNEFDAVTMNCSDISLNVKDCVLDFSKSVPLPRDNTKVPMTPVIRTAAERPRSQGLLENLVAMIKRNFNSPELSGTVDMENTASVVADRFFDSYFLKDKLSGCSLGDSGGKNIIDRQALIRWMEKQEKSTIGQLADYDFVDLPAIDQYRHIIKSQPKQKLDLSIQSEYPSLQTIVYHSKKINALFGPIFSELTRQMLSAIDTSRYLFFTRKTPEQIEEFFSDLDAHQPMEVLELDVSKYDKSQNEFHCAVEYEIWKRLGIDEFLAEVWKQGHRKTTLKDYTAGIKTCLWYQRKSGDVTTFIGNTVIIAACMASMLPMEKVIKAAFCGDDSLVYLPKGCELPNIQSCANLMWNFEAKLFKKTYGYFCGRYVIHHDRGAIVYVDPLKIISKLGAKHITDKEHLEEFRISLADVSKSLNNCAYYAQLDEAVREVHKTAPPGSFVYKCIVKFLSNRVLFESLFF

SEQ ID NO: 158 - protein, 1609 aa, Tobacco mild green mosaic virus
  misc_feature (1112)..(1112): Xaa can be any naturally occurring amino acid
MAHIQSTISNALLESVSGKNTLVNDLARRRMYDTTVDEFNARDRRPKVNFSKTISEEQTLLVSNAYPEFQITFYNTQNAVHSLAGGLRALELEYLMLQVPYGSPTYDIGGNFAAHLFKGRDYVHCCMPNLDIRDIMRHEGQKDSIEMYLSRLSRSNKVIPEFQREAFNRYAEAPNEVCCSKTFQDCRIHPPENSGRRYAVALHSLYDIPVHEFGAALISKNIHVCYAAFHFAEALLLDQTEVTLNEIGATFKREGDDVSFFFADESTLNYSHKYKNILHYVVKSYFPASSRIVYFKEFLVTRVNTWFCKFTKVDTYILYKSVRQVGCDSDQFYEAMEDAFAYKKTLAMFNTERAIFRDTASVNFWFPKMKDMVIVPLFEGSITSKRMTRSEVIVNRDFVYTVLNHIRTYQAKALTYQNVLSFVESIRSRVIINGVTARSEWDVDKAILQPLSMAFFLQTKLAALQDDIVMGKFRCLDKTTSELIWDEVGKFFGNVFPTIKERLVSRKILDVSENALKIKIPDLYVTWKDRFVAEYTKSEELPHLDIKKDLEEAEQMYDALSELSILKGADNFDIAKFKDMCKALDVSPDVAARVIVAVAENRSGLTLTFDKPTEENVVKALKSTASEAVVCLEPTSEEVNVNKFSIAEKGRLPVCAEGHGLTSANLEHQELESLNDFHKACVDSVITKQMASVVYTGSLKVQQMKNYVDSLAASLPATVSNLCKSLKDVVGYDSDSREKVGVWDVTLKKWLLKPAAKGHSWGVVLDYKGKMFTALLSYEGDRMVTESDWRRVAVSSDTMVYSDIAKLQNLRKTMRDGEPHEPTAKMVLVDGVPGCGKTKEILERVDLDEDLILVPGKQAAAMIRRRANSSGLIRATMDNVRTVDSFLMHPKPRSHKRLFIDEGLMLHTGCVNFLVLISGCDIAYIYGDTQQIPFINRVQNFPYPKHFEKLQVDEVEMRRTTLRCPGDVNFFLQSKYEGAVSTTSTVQRSVSSEMIGGKGVLNSVSKPLKGKIVTFTQADKFELEEKGYKNVNTVHEIQGETFEDVSLVRLTATPLTLISKSSPHVLVALTRHTKSFKYYTVVLDPLVQIISDLSSLSSFLLEMYMVEAGSKXQLQMDAVFKGHNLFVATPKSGDFPDLQFYYDVCLPGNSTILNKYDAVTMRLRDNSLNVKDCVLDFSKSIPMPKEVKPCLEPVLRTAAEPPRAAGLLENLVAMIKRNFNAPDLTGTIDIESTASVVVDKFFDSYFIKKEKYTKNIAGVMTKDSMMRWLGKQERSTIGQLANYNFVDLPAIDQYKHMIKAQPKQKLDLSIQNEYPALQTIVYHSKQINGIFGPVFSELTRLLLEAVDSQKFLFFTRKTPEQIQEFFSDLDSHVPMDVLELDISKYDKSQNEFHCAVEYEIWKRLGLNEFLAEVWKQGHRKTTLKDYIAGIKTCLWYQRKSGDVTTFIGNTVIIAACLGSMLPMEKVIKGAFCGDDSVLYFPKGLDFPDIQSCANLMWNFEAKLYRKRYGYFCGRYIIHHDKGAIVYYDPLKLISKLGAKHIKDYDHLEELRVSLCDVACSLGNCAYFPQLNAAIKEVHKTAIDGSFAFNCVNKFLCDKFLFRTLFLNGC

SEQ ID NO: 159 - DNA, 168 bp, Artificial Sequence
  amplified sequence from plasmid pJL 165
tcattaattaacggcctaggtggaggaatgagttttaaaaagaataatttaatcgatgatgattcggaggctactgtcgccgaatcggattcgttttaaatagatcttacagtatcactactccatctcagttcgtgttcttgtcatagatgacgcagatgactctgt

SEQ ID NO: 160 - DNA, 20 bp, Artificial Sequence
  spacer sequence of the tomato VPE5 gene
gatgacgcagatgactctgt

SEQ ID NO: 161 - DNA, 806 bp, Artificial Sequence
  amplified sequence encoding sgRNA
gatgacgcagatgactctgtgttttagagctagaaatagcaagttaaaataaggctagtccgttatcaacttgaaaaagtggcaccgagtcggtgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggcccaggtacccggatgtgttttccgggctgatgagtccgtgaggacgaaaccctgcaggcatgcaagcttggcgtaatcatggtcatagcctagctagagtccgcaaatcaccagtctctctctacaaatctatctctctctattttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgacctgcagcccggccgggggatccactagcagattgtcgtttccggtacccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagg

SEQ ID NO: 162 - DNA, 1031 bp, Artificial Sequence
  SOE PCR product
gatgacgcagatgactctgtgttttagagctagaaatagcaagttaaaataaggctagtccgttatcaacttgaaaatcattaattaacggcctaggtggaggaatgagttttaaaaagaataatttaatcgatgatgattcggaggctactgtcgccgaatcggattcgttttaaatagatcttacagtatcactactccatctcagttcgtgttcttgtcatagatgacgcagatgactctgtgttttagagctagaaatagcaagttaaaataaggctagtccgttatcaacttgaaaaagtggcaccgagtcggtgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggcccaggtacccggatgtgttttccgggctgatgagtccgtgaggacgaaaccctgcaggcatgcaagcttggcgtaatcatggtcatagcctagctagagtccgcaaatcaccagtctctctctacaaatctatctctctctattttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgacctgcagcccggccgggggatccactagcagattgtcgtttccggtacccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagg

SEQ ID NO: 163 - DNA, 42 bp, Artificial Sequence
  Primer JAL 563
tcattaattaacggcctaggtggaggaatgagttttaaaaag

SEQ ID NO: 164 - DNA, 20 bp, Artificial Sequence
  Primer JAL 753
cctgtggttggcatgcacat

SEQ ID NO: 165 - DNA, 44 bp, Artificial Sequence
  Primer JAL 766
gatgacgcagatgactctgtgttttagagctagaaatagcaagt

SEQ ID NO: 166 - DNA, 47 bp, Artificial Sequence
  Primer JAL 778
acagagtcatctgcgtcatctatgacaagaacacgaactgagatgga

SEQ ID NO: 167 - DNA, 5 bp, Unknown
  MiyI restriction endonuclease site
gagtc

SEQ ID NO: 168 - protein, 474 aa, Tobacco Mosaic Virus
MQFYYDKCLPGNSTMMNNFDAVTMRLTDISLNVKDCILDMSKSVAAPKDQIKPLIPMVRTAAEMPRQTGLLENLVAMIKRNFNAPELSGIIDIENTASLVVDKFFDSYLLKEKRKPNKNVSLFSRESLNRWLEKQEQVTIGQLADFDFVDLPAVDQYRHMIKAQPKQKLDTSIQTEYPALQTIVYHSKKINAIFGPLFSELTRQLLDSVDSSRFLFFTRKTPAQIEDFFGDLDSHVPMDVLELDISKYDKSQNEFHCAVEYEIWRRLGFEDFLGEVWKQGHRKTTLKDYTAGIKTCIWYQRKSGDVTTFIGNTVIIAACLASMLPMEKIIKGAFCGDDSLLYFPKGCEFPDVQHSANLMWNFEAKLFKKQYGYFCGRYVIHHDRGCIVYYDPLKLISKLGAKHIKDWEHLEEFRRSLCDVAVSLNNCAYYTQLDDAVWEVHKTAPPGSFVYKSLVKYLSDKVLFRSLFIDGSSC

SEQ ID NO: 169 - DNA, 24 bp, Artificial Sequence
  VPE5 locus primer - forward
gttcacgtcgccggagttttcatc

SEQ ID NO: 170 - DNA, 24 bp, Artificial Sequence
  VPE5 locus primer  - reverse
actttccttcatattttcaccaca

SEQ ID NO: 171 - DNA, 24 bp, Artificial Sequence
  VPE5 locus primer  - reverse 2
ccaagtgcaatgtatcctagctca

The invention claimed is:

1. A recombinant self-replicating RNA encoding at least
   i) a replicase capable of transcribing the recombinant self-replicating RNA wherein said replicase comprises a polypeptide having at least 90% sequence identity to SEQ ID No. 71;
   ii) a clustered regularly interspaced short palindromic repeats (CRISPR) endonuclease, which is a Type II Cas9 endonuclease or a Type V Cpf1 endonuclease; and
   iii) at least one guide RNA;
   wherein said at least one guide RNA is capable of directing sequence-specific binding of the CRISPR endonuclease to a target DNA.

2. The recombinant self-replicating RNA of claim 1, further encoding
   iv) a movement protein facilitating intercellular movement of the RNA.

3. The recombinant self-replicating RNA of claim 1, wherein the CRISPR endonuclease is a Type II Cas9 endonuclease.

4. The recombinant self-replicating RNA of claim 1, wherein the guide RNA has one or more additional nucleotides at its 5' and/or at its 3' end.

5. The recombinant self-replicating RNA of claim 4, wherein said additional nucleotides can comprise up to 1500 nucleotides.

6. The recombinant self-replicating RNA of claim 1, wherein the self-replicating RNA is derived from the genome of Tobacco Mosaic Virus (TMV).

7. A DNA vector comprising a polynucleotide encoding a recombinant self-replicating RNA, wherein said recombinant self-replicating RNA encodes at least:
   i) a replicase capable of transcribing the recombinant self-replicating RNA wherein said replicase comprises a polypeptide having at least 90% sequence identity to SEQ ID No. 71;
   ii) a clustered regularly interspaced short palindromic repeats (CRISPR) endonuclease, which is a Type II Cas9 endonuclease or a Type V Cpf1 endonuclease; and
   iii) at least one guide RNA;
   wherein said at least one guide RNA is capable of directing sequence-specific binding of the CRISPR endonuclease to a target DNA.

8. A method for editing the genome of a plant, said method comprising the steps of:
   a) introducing into a cell of the plant at least one recombinant self-replicating RNA, wherein said recombinant self-replicating RNA encodes at least
      i) a replicase capable of transcribing the recombinant self-replicating RNA, wherein said replicase comprises a polypeptide having at least 90% sequence identity to SEQ ID No. 71;
      ii) a clustered regularly interspaced short palindromic repeats (CRISPR) endonuclease, which is a Type II Cas9 endonuclease or a Type V Cpf1 endonuclease; and
      iii) at least one guide RNA,
      wherein said at least one guide RNA is capable of directing sequence-specific binding of the CRISPR endonuclease to a target DNA;
   wherein elements (i), (ii), and (iii) are expressed in the cell, and the CRISPR endonuclease cleaves the cell's genome at the target DNA, thereby editing the plant genome.

9. The method of claim 8, said method comprising: introducing into the cell of the plant, a DNA vector comprising a polynucleotide encoding the recombinant self-replicating RNA.

10. The method claim 8, wherein the CRISPR endonuclease is a Type II Cas9 endonuclease.

11. The method of claim 8, wherein the introducing step comprises a step selected from the group consisting of:
   i) agroinfiltrating a DNA vector comprising a polynucleotide encoding the recombinant self-replicating RNA, into the plant cell;
   ii) contacting the recombinant self-replicating RNA or a DNA vector comprising a polynucleotide encoding the recombinant self-replicating RNA, with the plant cell;
   iii) electroporating the recombinant self-replicating RNA, or a DNA vector comprising a polynucleotide encoding said recombinant self-replicating RNA, into the plant cell,
   iv) mechanical inoculation and/or
   v) biolistically delivering the recombinant self-replicating RNA, or a DNA vector comprising a polynucleotide encoding said recombinant self-replicating RNA, into the plant cell.

12. The method of claim 8, further comprising step b) screening the cell of the plant for the presence of a mutation in the target DNA of the plant cell genome.

13. The method of claim 12, further comprising step c) regenerating the plant cell comprising the mutation identified in step b).

14. A composition comprising at least one recombinant self-replicating RNA of claim 1.

15. A composition comprising the DNA vector of claim 7.

16. A cell comprising the recombinant self-replicating RNA of claim 1.

17. A cell comprising the DNA vector of claim 7.

18. The recombinant self-replicating RNA of claim 1, wherein the CRISPR endonuclease is a Type V Cpf1 endonuclease.

19. The method of claim 8, wherein the CRISPR endonuclease is a Type V Cpf1 endonuclease.

* * * * *